US010766960B2

(12) United States Patent
Igawa et al.

(10) Patent No.: US 10,766,960 B2
(45) Date of Patent: *Sep. 8, 2020

(54) HETERODIMERIZED POLYPEPTIDE

(71) Applicant: Chugai Seiyaku Kabushiki Kaisha, Tokyo (JP)

(72) Inventors: Tomoyuki Igawa, Shizuoka (JP); Futa Mimoto, Shizuoka (JP); Hitoshi Katada, Shizuoka (JP); Hirotake Shiraiwa, Shizuoka (JP)

(73) Assignee: Chugai Seiyaku Kabushiki Kaisha, Tokyo (JP)

( * ) Notice: Subject to any disclaimer, the term of this patent is extended or adjusted under 35 U.S.C. 154(b) by 532 days.

This patent is subject to a terminal disclaimer.

(21) Appl. No.: 14/654,895

(22) PCT Filed: Dec. 26, 2013

(86) PCT No.: PCT/JP2013/084809
§ 371 (c)(1),
(2) Date: Jun. 23, 2015

(87) PCT Pub. No.: WO2014/104165
PCT Pub. Date: Jul. 3, 2014

(65) Prior Publication Data
US 2015/0344570 A1 Dec. 3, 2015

(30) Foreign Application Priority Data
Dec. 27, 2012 (JP) ................. 2012-284129

(51) Int. Cl.
C07K 16/00 (2006.01)
C12P 21/08 (2006.01)
C07K 16/28 (2006.01)
C07K 16/46 (2006.01)
C07K 16/30 (2006.01)
C07K 1/00 (2006.01)

(52) U.S. Cl.
CPC ............ *C07K 16/283* (2013.01); *C07K 16/00* (2013.01); *C07K 16/303* (2013.01); *C07K 16/46* (2013.01); *C07K 2317/31* (2013.01); *C07K 2317/52* (2013.01); *C07K 2317/524* (2013.01); *C07K 2317/72* (2013.01); *C07K 2317/732* (2013.01); *C07K 2319/33* (2013.01)

(58) Field of Classification Search
None
See application file for complete search history.

(56) References Cited

U.S. PATENT DOCUMENTS

| | | | |
|---|---|---|---|
| 6,344,443 B1 | 2/2002 | Liu et al. | |
| 6,737,056 B1 * | 5/2004 | Presta | C07K 16/4291 424/133.1 |
| 6,852,318 B1 | 2/2005 | Varner | |
| 6,946,292 B2 | 9/2005 | Kanda et al. | |
| 7,229,960 B2 | 6/2007 | Pero et al. | |
| 7,317,091 B2 | 1/2008 | Lazar et al. | |
| 7,393,531 B2 | 7/2008 | Young et al. | |
| 7,662,925 B2 | 2/2010 | Lazar et al. | |
| 7,951,917 B1 * | 5/2011 | Arathoon | C07K 16/00 424/130.1 |
| 7,960,512 B2 | 6/2011 | Stavenhagen et al. | |
| 8,101,720 B2 | 1/2012 | Lazar et al. | |
| 8,524,867 B2 | 9/2013 | Bernett et al. | |
| 8,685,725 B2 | 4/2014 | Beliard et al. | |
| 8,735,545 B2 | 5/2014 | Lazar et al. | |
| 8,802,823 B2 | 8/2014 | Lazar et al. | |
| 9,017,684 B2 | 4/2015 | Aburatani et al. | |
| 9,029,515 B2 | 5/2015 | Pons et al. | |
| 9,051,373 B2 | 6/2015 | Lazar et al. | |
| 9,079,949 B1 | 7/2015 | Andrien, Jr. et al. | |
| 9,107,861 B1 | 8/2015 | Andrien, Jr. et al. | |
| 9,200,060 B2 | 12/2015 | Kannan et al. | |
| 9,556,264 B2 | 1/2017 | Shiraiwa et al. | |
| 9,890,218 B2 | 2/2018 | Mimoto et al. | |
| 2004/0001822 A1 | 1/2004 | Levanon et al. | |
| 2004/0001839 A1 | 1/2004 | Levanon et al. | |
| 2004/0002450 A1 | 1/2004 | Lezarovits et al. | |
| 2004/0110226 A1 | 6/2004 | Lazar et al. | |
| 2005/0260213 A1 | 11/2005 | Koenig et al. | |

(Continued)

FOREIGN PATENT DOCUMENTS

AU 2012/222252 10/2013
CA 2815266 5/2012

(Continued)

OTHER PUBLICATIONS

Wang et al., "Monoclonal Antibodies with Identical Fc Sequences Can Bind to FcRn Differentially with Pharmacokinetic Consequences," Drug Metabolism and Disposition, Sep. 2011; 39(9):1469-77.
USPTO Interview Summary in U.S. Appl. No. 14/127,576, dated Dec. 23, 2016, 3 pages.
USPTO Restriction Requirement in U.S. Appl. No. 14/406,232, dated Apr. 27, 2016, 15 pages.
Fish & Richardson P.C., Response to Restriction Requirement dated Apr. 27, 2016 in U.S. Appl. No. 14/406,232, filed on Jul. 26, 2016, 2 pages.
USPTO Non-Final Office Action in U.S. Appl. No. 14/406,232, dated Oct. 20, 2016, 37 pages.

(Continued)

*Primary Examiner* — Chun W Dahle

(74) *Attorney, Agent, or Firm* — Fish & Richardson P.C.

(57) ABSTRACT

The present inventors produced a heterodimerized polypeptide having an Fc region formed from two polypeptides with different amino acid sequences (a first polypeptide and a second polypeptide), and succeeded in producing a heterodimerized polypeptide containing an Fc region with improved function compared to that of a homodimer in which the Fc region is composed of only the first polypeptide or the second polypeptide by conventional technology.

17 Claims, 54 Drawing Sheets
Specification includes a Sequence Listing.

(56) References Cited

U.S. PATENT DOCUMENTS

| | | |
|---|---|---|
| 2006/0134709 A1 | 6/2006 | Stavenhagen et al. |
| 2006/0275283 A1* | 12/2006 | van Vlijmen .......... C07K 16/00 424/130.1 |
| 2007/0231329 A1 | 10/2007 | Lazar et al. |
| 2007/0248602 A1 | 10/2007 | Lazar et al. |
| 2008/0044417 A1 | 2/2008 | Johnson et al. |
| 2008/0051563 A1 | 2/2008 | Lazar et al. |
| 2008/0138349 A1 | 6/2008 | Stavenhagen et al. |
| 2008/0181890 A1 | 7/2008 | Lazar et al. |
| 2008/0199471 A1 | 8/2008 | Bernett et al. |
| 2009/0035836 A1 | 2/2009 | Datta et al. |
| 2009/0041770 A1 | 2/2009 | Chamberlain et al. |
| 2009/0076251 A1 | 3/2009 | Koenig et al. |
| 2009/0136485 A1 | 5/2009 | Chu et al. |
| 2010/0098730 A1 | 4/2010 | Lowman et al. |
| 2010/0184959 A1 | 7/2010 | Guler-Gane et al. |
| 2010/0249482 A1 | 9/2010 | Chung et al. |
| 2010/0286374 A1 | 11/2010 | Kannan et al. |
| 2010/0331527 A1 | 12/2010 | Davis et al. |
| 2011/0021755 A1 | 1/2011 | Lazar et al. |
| 2011/0027276 A1 | 2/2011 | Bernett et al. |
| 2011/0111406 A1 | 5/2011 | Igawa et al. |
| 2011/0223658 A1 | 9/2011 | Beliard et al. |
| 2011/0229489 A1 | 9/2011 | Pons et al. |
| 2012/0093818 A1 | 4/2012 | Jackson et al. |
| 2012/0149876 A1 | 6/2012 | Von Kreudenstein et al. |
| 2012/0244578 A1* | 9/2012 | Kannan ................. C07K 16/00 435/69.6 |
| 2013/0085265 A1 | 4/2013 | Jackson et al. |
| 2013/0101581 A1 | 4/2013 | Kuramochi et al. |
| 2013/0131319 A1 | 5/2013 | Igawa et al. |
| 2013/0247234 A1 | 9/2013 | McWhirter et al. |
| 2013/0259876 A1 | 10/2013 | Murphy et al. |
| 2014/0044730 A1 | 2/2014 | Yancopoulos et al. |
| 2014/0082760 A1 | 3/2014 | McWhirter et al. |
| 2014/0093496 A1 | 4/2014 | Mimoto et al. |
| 2014/0105889 A1 | 4/2014 | Igawa et al. |
| 2014/0112914 A1 | 4/2014 | Nezu et al. |
| 2014/0112926 A1 | 4/2014 | Liu |
| 2014/0199294 A1 | 7/2014 | Mimoto et al. |
| 2014/0234340 A1 | 8/2014 | Igawa et al. |
| 2014/0335089 A1 | 11/2014 | Igawa et al. |
| 2014/0356371 A1 | 12/2014 | Swergold et al. |
| 2015/0166636 A1 | 6/2015 | Igawa et al. |
| 2015/0166654 A1 | 6/2015 | Igawa et al. |
| 2015/0203577 A1 | 7/2015 | Igawa et al. |
| 2015/0252107 A1 | 9/2015 | Stevis et al. |
| 2015/0299296 A1 | 10/2015 | Katada et al. |
| 2015/0299313 A1 | 10/2015 | Igawa et al. |
| 2015/0353630 A1 | 12/2015 | Igawa et al. |
| 2016/0039912 A1 | 2/2016 | Mimoto et al. |
| 2016/0046693 A1 | 2/2016 | Igawa |
| 2016/0159904 A1 | 6/2016 | Yamazaki et al. |
| 2016/0200807 A1 | 7/2016 | Ruike et al. |
| 2016/0229915 A1 | 8/2016 | Igawa et al. |
| 2017/0129950 A1 | 5/2017 | Shiraiwa et al. |
| 2018/0258161 A1 | 9/2018 | Igawa et al. |
| 2019/0112393 A1 | 4/2019 | Igawa et al. |

FOREIGN PATENT DOCUMENTS

| | | |
|---|---|---|
| CA | 2827923 | 8/2012 |
| CN | 1291198 | 4/2001 |
| CN | 1763097 | 4/2006 |
| CN | 101001873 | 7/2007 |
| CN | 101014619 | 8/2007 |
| CN | 102056946 | 5/2011 |
| CN | 103492565 | 1/2014 |
| CN | 103827300 | 5/2014 |
| CN | 102633880 | 2/2015 |
| EP | 2 196 541 | 6/2010 |
| EP | 2 275 443 | 1/2011 |
| EP | 2 368 911 | 9/2011 |
| EP | 2 647 706 | 10/2013 |
| EP | 2 679 681 | 1/2014 |
| EP | 2 698 431 | 2/2014 |
| EP | 2 728 002 | 5/2014 |
| EP | 2 762 166 | 8/2014 |
| EP | 2 889 377 | 7/2015 |
| EP | 2 940 135 | 11/2015 |
| JP | 2003-512019 | 4/2003 |
| JP | 2006-512407 | 4/2006 |
| JP | 2006-524039 | 10/2006 |
| JP | 2007-532139 | 11/2007 |
| JP | 2008-505174 | 2/2008 |
| JP | 2008-511292 | 4/2008 |
| JP | 2008-514201 | 5/2008 |
| JP | 2009-511067 | 3/2009 |
| JP | 2009-511587 | 3/2009 |
| JP | 2009-538273 | 11/2009 |
| JP | 2009-540837 | 11/2009 |
| JP | 2010-514460 | 5/2010 |
| JP | 6433297 | 12/2018 |
| KR | 2011/0004435 | 1/2011 |
| RU | 2236222 | 9/2004 |
| RU | 2005/112742 | 1/2006 |
| RU | 2006/142852 | 6/2008 |
| RU | 2337107 | 10/2008 |
| RU | 2390527 | 5/2010 |
| RU | 2398777 | 9/2010 |
| SG | 192945 | 9/2013 |
| TW | 2011/16625 | 5/2011 |
| TW | 2012/02419 | 1/2012 |
| WO | WO 95/14714 | 6/1995 |
| WO | WO 99/40117 | 8/1999 |
| WO | WO 99/58572 | 11/1999 |
| WO | WO 00/15214 | 3/2000 |
| WO | WO 00/42072 | 7/2000 |
| WO | WO 2002/079255 | 10/2002 |
| WO | WO 2004/029207 | 4/2004 |
| WO | WO 2004/063351 | 7/2004 |
| WO | WO 2004/099249 | 11/2004 |
| WO | WO 2005/059106 | 6/2005 |
| WO | WO 2005/115452 | 12/2005 |
| WO | WO 2006/015371 | 2/2006 |
| WO | WO 2006/019447 | 2/2006 |
| WO | WO 2006/020114 | 2/2006 |
| WO | WO 2006/036291 | 4/2006 |
| WO | WO 2006/036834 | 4/2006 |
| WO | WO 2006/072620 | 7/2006 |
| WO | WO 2006/076594 | 7/2006 |
| WO | WO 2006/083706 | 8/2006 |
| WO | WO 2006/085938 | 8/2006 |
| WO | WO 2006/088494 | 8/2006 |
| WO | WO 2006/106905 | 10/2006 |
| WO | WO 2006/133486 | 12/2006 |
| WO | WO 2007/024249 | 3/2007 |
| WO | WO 2007/047291 | 4/2007 |
| WO | WO 2007/047578 | 4/2007 |
| WO | WO 2007/114325 | 10/2007 |
| WO | WO 2007/121354 | 10/2007 |
| WO | WO 2008/002933 | 1/2008 |
| WO | WO 2008/003103 | 1/2008 |
| WO | WO 2008/091954 | 7/2008 |
| WO | WO 2008/150494 | 12/2008 |
| WO | WO 2009/041062 | 4/2009 |
| WO | WO 2009/062083 | 5/2009 |
| WO | WO 2009/125825 | 10/2009 |
| WO | WO 2009/139822 | 11/2009 |
| WO | WO 2009/155513 | 12/2009 |
| WO | WO 2010/058860 | 5/2010 |
| WO | WO 2010/077854 | 7/2010 |
| WO | WO 2010/085682 | 7/2010 |
| WO | WO 2010/107109 | 9/2010 |
| WO | WO 2011/091078 | 7/2011 |
| WO | WO 2011/107989 | 9/2011 |
| WO | WO 2011/108714 | 9/2011 |
| WO | WO 2011/111007 | 9/2011 |
| WO | WO 2011/122011 | 10/2011 |
| WO | WO 2012/044831 | 4/2012 |
| WO | WO 2012/058768 | 5/2012 |
| WO | WO 2012/073985 | 6/2012 |
| WO | WO 2012/073992 | 6/2012 |

(56) References Cited

FOREIGN PATENT DOCUMENTS

| WO | WO 2012/115241 | 8/2012 |
| --- | --- | --- |
| WO | WO 2012/125850 | 9/2012 |
| WO | WO 2012/132067 | 10/2012 |
| WO | WO 2012/133782 | 10/2012 |
| WO | WO 2013/002362 | 1/2013 |
| WO | WO 2013/047729 | 4/2013 |
| WO | WO 2013/047748 | 4/2013 |
| WO | WO 2013/047752 | 4/2013 |
| WO | WO 2013/063702 | 5/2013 |
| WO | WO 2013/100120 | 7/2013 |
| WO | WO 2013/118858 | 8/2013 |
| WO | WO 2013/125667 | 8/2013 |
| WO | WO 2013/138681 | 9/2013 |
| WO | WO 2013/180200 | 12/2013 |
| WO | WO 2013/187495 | 12/2013 |
| WO | WO 2014/030728 | 2/2014 |
| WO | WO 2014/104165 | 7/2014 |
| WO | WO 2014/140366 | 9/2014 |
| WO | WO 2014/144080 | 9/2014 |
| WO | WO 2014/144577 | 9/2014 |
| WO | WO 2014/150983 | 9/2014 |
| WO | WO 2014/163101 | 10/2014 |
| WO | WO 2014/164959 | 10/2014 |
| WO | WO 2015/042250 | 3/2015 |
| WO | WO 2015/077491 | 5/2015 |
| WO | WO 2015/134894 | 9/2015 |

OTHER PUBLICATIONS

USPTO Restriction Requirement in U.S. Appl. No. 14/001,218, dated Dec. 2, 2015, 8 pages.
Fish & Richardson P.C., Reply to Restriction Requirement dated Dec. 2, 2015 in U.S. Appl. No. 14/001,218, filed on Feb. 1, 2016, 1 page.
USPTO Office Action in U.S. Appl. No. 14/001,218, dated Apr. 4, 2016, 13 pages.
Fish & Richardson P.C., Reply to Office Action dated Apr. 4, 2016 in U.S. Appl. No. 14/001,218, filed on Oct. 3, 2016, 15 pages.
USPTO Office Action in U.S. Appl. No. 14/001,218, dated Dec. 2, 2016, 10 pages.
USPTO Interview Summary in U.S. Appl. No. 14/001,218, dated Jan. 12, 2017, 3 pages.
Non-Final Office Action for U.S. Appl. No. 14/422,207, dated Feb. 11, 2016, 11 pages.
Fish & Richardson P.C., Reply to Non-Final Office Action dated Feb. 11, 2016, in U.S. Appl. No. 14/422,207, filed on Aug. 10, 2016, 24 pages.
Fish & Richardson P.C., Supplemental Reply to Non-Final Office Action dated Feb. 11, 2016, in U.S. Appl. No. 14/422,207, filed on Oct. 13, 2016, 24 pages.
Non-Final Office Action for U.S. Appl. No. 14/422,207, dated Feb. 7, 2017, 17 pages.
Bjellqvist et al., "The focusing positions of polypeptides in immobilized pH gradients can be predicted from their amino acid sequences," Electrophoresis. Oct. 1993;14(10):1023-31.
USPTO Office Action in U.S. Appl. No. 14/001,218, dated Jun. 27, 2017, 12 pages.
Maurer et al., "Antigenicity of polypeptides (poly alpha amino acids): calcium-dependent and independent antibodies," J Immunol., Sep. 1970;105(3):567-73.
Meulenbroek et al., "Properties of human IgG subclasses," Chapter 2.3 of Human IgG Subclasses: Useful Diagnostic Markers for Immunocompetence, published online by Sanquin, Amsterdam, The Netherlands. Retrieved from the Internet on Mar. 23-24, 2017: <http://ednieuw.home.xs4all.nl/IgGsubclasses/subk123.htm>, 8 pages.
Warncke et al., "Different adaptations of IgG effector function in human and nonhuman primates and implications for therapeutic antibody treatment," J lmmunol. May 1, 2012 :188(9) :4405-11. doi: 10.4049/jimmunol. 1200090. Epub Mar. 28, 2012.
Fish & Richardson P.C., Reply to Non-Final Office Action of Sep. 20, 2016 in U.S. Appl. No. 14/127,576, dated Mar. 16, 2017, 21 pages.

Colman, "Effects of amino acid sequence changes on antibody-antigen interactions," Res. Immunol., Dec. 31, 1994; 145(1):33-36.
Edelman et al., "The covalent structure of an entire gammaG immunoglobulin molecule," Proc. Natl. Acad. Sci. U S A., May 1969;63(1):78-85.
IMGT Scientific Chart (Correspondence between the IMGT unique numbering for C-DOMAIN, the IMGT exon numbering, the Eu and Kabat numberings: Human IGH G), [online] http://www.imgt.org/IMGTScientificChart/Numbering/Hu_IGHGnber.html, downloaded Aug. 9, 2017, 8 pages.
Ito et al., "The His-probe method: effects of histidine residues introduced into the complementarity-determining regions of antibodies on antigen-antibody interactions at different pH values," FEBS Lett., 309:85-88 (1992).
Maxfield et al., "Endocytic Recycling," Nat. Rev. Mol. Cell Biol., Feb. 2004; 5(2):121-132.
Rudikoff et al., "Single amino acid substitution altering antigen-binding specificity," Proc. Natl. Acad. Sci. U S A., Mar. 198;79(6):1979-83.
Vidarsson et al., "IgG subclasses and allotypes: from structure to effector functions," Front Immunol , Oct. 20, 2014;5:520. doi:10.3389/fimmu.2014.00520. eCollection 2014.
USPTO Notice of Allowance in U.S. Appl. No. 14/127,576, dated Oct. 19, 2017, 9 pages.
USPTO Notice of Allowance in U.S. Appl. No. 14/127,576, dated Dec. 15, 2017, 8 pages.
USPTO Notice of Non-Compliant Amendment in U.S. Appl. No. 14/406,232, dated Jul. 25, 2017, 4 pages.
USPTO Final Office Action in U.S. Appl. No. 14/406,232, dated Nov. 13, 2017, 26 pages.
USPTO Final Office Action in U.S. Appl. No. 14/001,218, dated Dec. 16, 2016, 11 pages.
Final Office Action for U.S. Appl. No. 14/422,207, dated Nov. 16, 2017, 30 pages.
Restriction Requirement for U.S. Appl. No. 14/900,928, dated May 18, 2017, 7 pages.
Non-Final Office Action for U.S. Appl. No. 14/900,928, dated Aug. 16, 2017, 43 pages.
Radaev et al., "The structure of a human type III Fcgamma receptor in complex with Fc," J Biol Chem., May 11, 2001;276(19):16469-77. Epub Jan. 31, 2001.
USPTO Notice of Allowance in U.S. Appl. No. 14/127,576, dated Jun. 2, 2017, 13 pages.
USPTO Notice of Allowance in U.S. Appl. No. 14/127,576, dated Jun. 21, 2017, 9 pages.
Fish & Richardson P.C., Response to Non-Final Office Action in U.S. Appl. No. 14/406,232, dated Apr. 20, 2017, 39 pages.
Fish & Richardson P.C., Reply to Office Action dated Dec. 16, 2016 in U.S. Appl. No. 14/001,218, filed on Jun. 16, 2017, 15 pages.
Burmeister et al., "Crystal structure of the complex of rat neonatal Fc receptor with Fc," Nature, Nov. 24, 1994;372(6504):379-83.
Mimoto et al., "Engineered antibody Fc variant with selectively enhanced FcγRIIb binding over both FcγRIIa(R131) and FcγRIIa(H131)," Protein Eng Des Sel., Oct. 2013;26(10):589-98. doi: 10.1093/protein/gzt022. Epub Jun. 5, 2013.
Sondermann et al., "The 3.2-A crystal structure of the human IgG1 Fc fragment-Fc gammaRIII complex," Nature, Jul. 20, 2000;406(6793):267-73.
Stevenson et al., "A chimeric antibody with dual Fc regions (bisFabFc) prepared by manipulations at the IgG hinge," Anticancer Drug Des., Mar. 1989;3(4):219-30.
International Search Report for App. Ser. No. PCT/JP2014/059706, dated Jul. 15, 2014, 4 pages.
International Preliminary Report on Patentability for App. Ser. No. PCT/JP2014/059706, dated Oct. 6, 2015, 10 pages.
Idusogie et al., "Engineered antibodies with increased activity to recruit complement," J Immunol., Feb. 15, 2001;166(4):2571-5.
Information Meeting on Antibody Engineering Technologies, Copyright © Chugai Pharmaceutical Co., Ltd., Dec. 18, 2012.
Liu et al., "Asymmetrical Fc engineering greatly enhances antibody-dependent cellular cytotoxicity (ADCC) effector function and sta-

(56) References Cited

OTHER PUBLICATIONS bility of the modified antibodies," J Biol Chem., Feb. 7, 2014;289(6):3571-90. doi: 10.1074/jbc.M113.513366. Epub Dec. 5, 2013.

Mimoto et al., "Novel asymmetrically engineered antibody Fc variant with superior FcγR binding affinity and specificity compared with afucosylated Fc variant," MAbs., Mar.-Apr. 2013;5(2):229-36. doi: 10.4161/mabs.23452. Epub Feb. 13, 2013.

Okabe, "Proprietary Innovative Antibody Engineering Technologies in Chugai Pharmaceutical," Information meeting on Antibody Engineering Technologies, Dec. 18, 2012.

Amigorena et al., "Cytoplasmic domain heterogeneity and functions of IgG Fc receptors in B lymphocytes," Science, 256(5065):1808-12 (1992).

Amigorena et al., "Fc gamma RII expression in resting and activated B lymphocytes," Eur J Immunol., (8):1379-85 (1989).

Armour et al., "Differential binding to human FcgammaRIIa and FcgammaRIIb receptors by human IgG wildtype and mutant antibodies," Mol Immunol., 40(9):585-93 (2003).

Blank et al., Decreased transcription of the human FCGR2B gene mediated by the −343 G/C promoter polymorphism and association with systemic lupus erythematosus. Hum Genet., Jul. 2005;117(2-3):220-7. Epub May 14, 2005.

Boruchov et al., "Activating and inhibitory IgG Fc receptors on human DCs mediate opposing functions," J Clin Invest., Oct. 2005;115(10):2914-23. Epub Sep. 15, 2005.

Boumpas et al., "A short course of BG9588 (anti-CD40 ligand antibody) improves serologic activity and decreases hematuria in patients with proliferative lupus glomerulonephritis," Arthritis Rheum., 48(3):719-27 (2003).

Bruhns et al., Specificity and affinity of human Fcgamma receptors and their polymorphic variants for human IgG subclasses, Blood, Apr. 16, 2009;113(16):3716-25. doi: 10.1182/blood-2008-09-179754. Epub Nov. 18, 2008.

Cartron et al., "Therapeutic activity of humanized anti-CD20 monoclonal antibody and polymorphism in IgG Fc receptor FcgammaRIIIa gene," Blood, 99(3):754-8 (2002).

Cemerski et al., "Suppression of mast cell degranulation through a dual-targeting tandem IgE-IgG Fc domain biologic engineered to bind with high affinity to FcγRIIb," Immunol Lett., Mar. 30, 2012;143(1):34-43. doi: 10.1016/j.imlet.2012.01.008. Epub Jan. 25, 2012.

Chan et al., "Therapeutic antibodies for autoimmunity and inflammation," Nat Rev Immunol., May 2010;10(5):301-16. doi: 10.1038/nri2761.

Chen et al., "Association of a transmembrane polymorphism of Fcgamma receptor IIb (FCGR2B) with systemic lupus erythematosus in Taiwanese patients," Arthritis Rheum., 54(12):3908-17 (2006).

Chu et al., "Inhibition of B cell receptor-mediated activation of primary human B cells by coengagement of CD19 and FcgammaRIIb with Fc-engineered antibodies," Mol Immunol., Sep. 2008;45(15):3926-33. doi: 10.1016/j.molimm.2008.06.027. Epub Aug. 8, 2008.

Chu et al., "Reduction of total IgE by targeted coengagement of IgE B-cell receptor and FcγRIIb with Fc-engineered antibody," J Allergy Clin Immunol., Apr. 2012;129(4):1102-15. doi: 10.1016/j.jaci.2011.11.029. Epub Jan. 16, 2012.

Chuntharapai et al., "Isotype-dependent inhibition of tumor growth in vivo by monoclonal antibodies to death receptor 4," J Immunol., 166(8):4891-8 (2001).

Clark, "IgG effector mechanisms," Chem Immunol., 1997;65:88-110.

Clynes et al., "Fc receptors are required in passive and active immunity to melanoma," Proc Natl Acad Sci USA, 95(2):652-6 (1998).

Clynes et al., "Inhibitory Fc receptors modulate in vivo cytotoxicity against tumor targets," Nat Med., 6(4):443-6 (2000).

Dall'Acqua et al., "Increasing the affinity of a human IgG1 for the neonatal Fc receptor: biological consequences," J. Immunol., 169(9):5171-80 (2002).

Datta-Mannan et al., "Monoclonal antibody clearance. Impact of modulating the interaction of IgG with the neonatal Fc receptor," J Biol Chem., Jan. 19, 2007;282(3):1709-17. Epub Nov. 29, 2006.

Davis et al., "SEEDbodies: fusion proteins based on strand-exchange engineered domain (SEED) CH3 heterodimers in an Fc analogue platform for asymmetric binders or immunofusions and bispecific antibodies," Protein Eng Des Sel., Apr. 2010;23(4):195-202. doi: 10.1093/protein/gzp094. Epub Feb. 4, 2010.

Desai et al., "Fc gamma receptor IIB on dendritic cells enforces peripheral tolerance by inhibiting effector T cell responses," J Immunol., 178(10):6217-26 (2007).

Dhodapkar et al., "Selective blockade of inhibitory Fcgamma receptor enables human dendritic cell maturation with IL-12p70 production and immunity to antibody-coated tumor cells," Proc Natl Acad Sci USA, Feb. 22, 2005;102(8):2910-5. Epub Feb. 9, 2005.

Duffau et al., "Platelet CD154 potentiates interferon-alpha secretion by plasmacytoid dendritic cells in systemic lupus erythematosus," Sci Transl Med., Sep. 1, 2010;2(47):47ra63. doi: 10.1126/scitranslmed.3001001.

Floto et al., "Loss of function of a lupus-associated FcgammaRIIb polymorphism through exclusion from lipid rafts," Nat Med., Oct. 2005;11(10):1056-8. Epub Sep. 18, 2005.

Fournier et al., "Activation of human peripheral IgM+ B cells is transiently inhibited by BCR-independent aggregation of Fc gammaRIIB," J Immunol., Oct. 15, 2008;181(8):5350-9.

Ghetie et al., "Increasing the serum persistence of an IgG fragment by random mutagenesis," Nat. Biotechnol., 15(7):637-40 (1997).

Greenwood et al., "Structural motifs involved in human IgG antibody effector functions," Eur J Immunol., May 1993;23(5):1098-104.

Gunasekaran et al., "Enhancing antibody Fc heterodimer formation through electrostatic steering effects: applications to bispecific molecules and monovalent IgG," J Biol Chem., 285(25):19637-46 (2010).

Hanson et al., "Catalytic antibodies and their applications," Curr. Opin. Biotechnol., Dec. 2005;16(6):631-6. Epub Oct. 21, 2005.

Hess et al., "Cancer therapy with trifunctional antibodies: linking innate and adaptive immunity," Future Oncol., Jan. 2012;8(1):73-85. doi: 10.2217/fon.11.138.

Heyman, "Feedback regulation by IgG antibodies," Immunol Lett., 88(2):157-61 (2003).

Hinton et al., "An engineered human IgG1 antibody with longer serum half-life," J. Immunol., 176(1):346-56 (2006).

Horton et al., "Potent in vitro and in vivo activity of an Fc-engineered anti-CD19 monoclonal antibody against lymphoma and leukemia," Cancer Res., 68(19):8049-57 (2008).

Igawa et al., "Antibody recycling by engineered pH-dependent antigen binding improves the duration of antigen neutralization," Nat Biotechnol., Nov. 2010;28(11):1203-7. doi: 10.1038/nbt.1691. Epub Oct. 17, 2010.

Igawa et al., "Antibody Optimization Technologies for Developing Next Generation Antibody Therapeutics," Bio Industry, 28(7):15-21 (2011) (with English translation).

Jefferis et al., "Interaction sites on human IgG-Fc for Fc gamma R: current models," Immunol Lett., Jun. 3, 2002;82(1-2):57-65.

Jones et al., "Growth factor receptor interplay and resistance in cancer," Endocr Relat Cancer, Dec. 2006;13 Suppl 1:S45-51.

Kim et al., "Antibody Engineering for the Development of Therapeutic Antibodies," Mol. Cells, 20(1):17-29 (2005).

Kohrt et al., "Stimulation of natural killer cells with a CD137-specific antibody enhances trastuzumab efficacy in xenotransplant models of breast cancer," J Clin Invest., Mar. 1, 2012;122(3):1066-75. doi: 10.1172/JCI61226. Epub Feb. 13, 2012.

Kontermann, "Dual targeting strategies with bispecific antibodies," MAbs., Mar.-Apr. 2012;4(2):182-97. doi: 10.4161/mabs.4.2.19000. Epub Mar. 1, 2012.

Lazar et al., "Engineered antibody Fc variants with enhanced effector function," Proc Natl Acad Sci USA, Mar. 2006;103(11):4005-10. Epub Mar. 6, 2006.

(56) References Cited

OTHER PUBLICATIONS

Li et al., "Apoptotic and antitumor activity of death receptor antibodies require inhibitory Fcγ receptor engagement," Proc Natl Acad Sci U S A., Jul. 3, 2012;109(27):10966-71. doi: 10.1073/pnas.1208698109. Epub Jun. 20, 2012.
Li et al., "CD72 down-modulates BCR-induced signal transduction and diminishes survival in primary mature B lymphocytes," J Immunol., 176(9):5321-8 (2006).
Li et al., "Inhibitory Fcγ receptor engagement drives adjuvant and anti-tumor activities of agonistic CD40 antibodies," Science, Aug. 19, 2011;333(6045):1030-4. doi: 10.1126/science.1206954.
Mackay et al., "Selective dysregulation of the FcgammaIIB receptor on memory B cells in SLE," J Exp Med., Sep. 4, 2006;203(9):2157-64. Epub Aug. 21, 2006.
Malbec et al., "Antibodies against growth factor receptors can inhibit the proliferation of transformed cells via a cis-interaction with inhibitory FcR," Immunol Lett., Mar. 30, 2012;143(1):2833.
Manger et al., "Fcgamma receptor IIa polymorphism in Caucasian patients with systemic lupus erythematosus: association with clinical symptoms," Arthritis Rheum., 41(7):1181-9 (1998).
Marvin et al., "Recombinant approaches to IgG-like bispecific antibodies," Acta Pharmacol Sin., Jun. 2005;26(6):649-58.
Meyer et al., "Bevacizumab immune complexes activate platelets and induce thrombosis in FCGR2A transgenic mice," J Thromb Haemost., Jan. 2009;7(1):171-81. Epub Oct. 30, 2008.
Mi et al., "Targeting the neonatal fc receptor for antigen delivery using engineered fc fragments," J Immunol., Dec. 1, 2008;181(11):7550-61.
Morgan et al., "The N-terminal end of the CH2 domain of chimeric human IgG1 anti-HLA-DR is necessary for C1q, Fc gamma RI and Fc gamma RIII binding," Immunology, Oct. 1995; 86(2):319-24.
Muta et al., "A 13-amino-acid motif in the cytoplasmic domain of Fc gamma RIIB modulates B-cell receptor signaling," Nature,368(6466):70-3 (1994).
Nakamura et al., "Fcgamma receptor IIB-deficient mice develop Goodpasture's syndrome upon immunization with type IV collagen: a novel murine model for autoimmune glomerular basement membrane disease," J Exp Med., Mar. 6, 2000;191(5):899-906.
Nicholas et al., "Regulation of the immune response. I. Reduction in ability of specific antibody to inhibit long-lasting IgG immunological priming after removal of the Fc fragment," J Exp Med., 129(6):1183-201 (1969).
Nimmerjahn et al., "Divergent immunoglobulin g subclass activity through selective Fc receptor binding," Science, 310(5753):1510-2 (2005).
Nimmerjahn et al., "Fcgamma receptors as regulators of immune responses," Nat Rev Immunol., Jan. 2008;8(1):34-47.
Olferiev et al., "The role of activating protein 1 in the transcriptional regulation of the human FCGR2B promoter mediated by the –343 G —> C polymorphism associated with systemic lupus erythematosus," J Biol Chem., Jan. 19, 2007;282(3):1738-46. Epub Nov. 27, 2006.
Pavlou et al., "The therapeutic antibodies market to 2008," Eur J Pharm Biopharm., Apr. 2005;59(3):389-96.
Radaev et al., "The role of Fc glycosylation and the binding of peptide inhibitors," J Biol Chem., May 11, 2001;276(19):16478-83. Epub Jan. 31, 2001.
Rajpal et al., A general method for greatly improving the affinity of antibodies by using combinatorial libraries, Proc. Natl. Acad. Sci. USA, Jun. 14, 2005;102(24):8466-71. Epub Jun. 6, 2005.
Rathanaswami et al., "Demonstration of an in vivo generated sub-picomolar affinity fully human monoclonal antibody to interleukin-8," Biochem. Biophys. Res. Commun., 334(4):1004-13 (2005).
Ravetch et al., "Immune inhibitory receptors," Science, 290(5489):84-9 (2000).
Reichert et al., "Monoclonal antibody successes in the clinic," Nat Biotechnol., Sep. 2005;23(9):1073-8.
Reverberi et al., "Factors affecting the antigen-antibody reaction," Blood Transfus., Nov. 2007;5(4):227-40. doi: 10.2450/2007.0047-07.
Richards et al., "Optimization of antibody binding to FcgammaRIIa enhances macrophage phagocytosis of tumor cells," Mol Cancer Ther., Aug. 2008;7(8):2517-27. doi: 10.1158/1535-7163.MCT-08-0201.
Riechelmann et al., "Adoptive therapy of head and neck squamous cell carcinoma with antibody coated immune cells: a pilot clinical trial," Cancer Immunol Immunother., Sep. 2007;56(9):1397-406. Epub Feb. 2, 2007.
Robles-Carrillo et al., "Anti-CD40L immune complexes potently activate platelets in vitro and cause thrombosis in FCGR2A transgenic mice," J Immunol., Aug. 1, 2010;185(3):1577-83. doi: 10.4049/jimmunol.0903888. Epub Jun. 28, 2010.
Rothe et al., "Recombinant proteins in rheumatology—recent advances," N Biotechnol., Sep. 2011;28(5):502-10. doi: 10.1016/j.nbt.2011.03.019. Epub Apr. 5, 2011.
Salmon et al., "Fc gamma RIIA alleles are heritable risk factors for lupus nephritis in African Americans," J Clin Invest., 97(5):1348-54 (1996).
Samuelsson et al., "Anti-inflammatory activity of IVIG mediated through the inhibitory Fc receptor," Science, 291(5503):484-6 (2001).
Scappaticci et al., "Arterial thromboembolic events in patients with metastatic carcinoma treated with chemotherapy and bevacizumab," J Natl Cancer Inst., Aug. 15, 2007;99(16):1232-9. Epub Aug. 8, 2007.
Seimetz et al., "Development and approval of the trifunctional antibody catumaxomab (anti-EpCAM x anti-CD3) as a targeted cancer immunotherapy," Cancer Treat Rev., Oct. 2010;36(6):458-67. doi: 10.1016/j.ctrv.2010.03.001. Epub Mar. 27, 2010.
Shields et al., "High resolution mapping of the binding site on human IgG1 for Fc gamma RI, Fc gamma RII, Fc gamma RIII, and FcRn and design of IgG1 variants with improved binding to the Fc gamma R," J Biol Chem., Mar. 2, 2001;276(9):6591-604. Epub Nov. 28, 2000.
Shinkawa et al., "The absence of fucose but not the presence of galactose or bisecting N-acetylglucosamine of human IgG1 complex-type oligosaccharides shows the critical role of enhancing antibody-dependent cellular cytotoxicity," J Biol Chem., Jan. 31, 2003;278(5):3466-73. Epub Nov. 8, 2002.
Siberil et al., "Molecular aspects of human FcgammaR interactions with IgG: functional and therapeutic consequences," Immunol Lett., Aug. 15, 2006;106(2):111-8. Epub Jun. 12, 2006.
Smith et al., "FcgammaRIIB in autoimmunity and infection: evolutionary and therapeutic implications," Nat Rev Immunol., May 2010;10(5):328-43. doi: 10.1038/nri2762.
Su et al., Expression profile of FcgammaRIIB on leukocytes and its dysregulation in systemic lupus erythematosus, J Immunol., 178(5):3272-80 (2007).
Suzuki et al., "Importance of neonatal FcR in regulating the serum half-life of therapeutic proteins containing the Fc domain of human IgG1: a comparative study of the affinity of monoclonal antibodies and Fc-fusion proteins to human neonatal FcR," J Immunol., Feb. 15, 2010;184(4):1968-.76. doi: 10.4049/jimmunol.0903296. Epub Jan. 18, 2010.
Traxlmayr et al., "Integral binding human antibody constant domains--probing the C-terminal structural loops for grafting the RGD motif," J Biotechnol., Sep. 10, 2011;155(2):193-202. doi: 10.1016/j.jbiotec.2011.06.042. Epub Jul. 8, 2011.
Unkeless et al., "Structure and function of human and murine receptors for IgG," Annu Rev Immunol., 1988;6:251-81.
Veri et al., "Monoclonal antibodies capable of discriminating the human inhibitory Fcgamma-receptor IIB (CD32B) from the activating Fcgamma-receptor IIA (CD32A): biochemical, biological and functional characterization," Immunology, 121(3):392-404 (2007).
Veri et al., "Therapeutic control of B cell activation via recruitment of Fcgamma receptor IIb (CD32B) inhibitory function with a novel bispecific antibody scaffold," Arthritis Rheum., Jul. 2010;62(7):1933-43. doi: 10.1002/art.27477.
Warmerdam et al., Molecular basis for a polymorphism of human Fc gamma receptor II.(CD32), J Exp Med., 172(1):19-25 (1990).
Wenink et al., "The inhibitory Fc gamma IIb receptor dampens TLR4-mediated immune responses and is selectively up-regulated on dendritic cells from rheumatoid arthritis patients with quiescent

(56) References Cited

OTHER PUBLICATIONS disease," J Immunol., Oct. 1, 2009;183(7):4509-20. doi: 10.4049/jimmunol.0900153. Epub Sep. 4, 2009.

Wernersson et al., "IgG-mediated enhancement of antibody responses is low in Fc receptor gamma chain-deficient mice and increased in Fc gamma Rii-deficient mice," J Immunol.,.163(2):618-22 (1999).

Wilson et al., "An Fcγ receptor-dependent mechanism drives antibody-mediated target-receptor signaling in cancer cells," Cancer Cell, Jan 18, 2011;19(1):101-13. doi: 10.1016/j.ccr.2010.11.012.

Wozniak-Knopp et al., "Introducing antigen-binding sites in structural loops of immunoglobulin constant domains: Fc fragments with engineered HER2/neu-binding sites and antibody properties," Protein Eng Des Sel., Apr. 2010;23(4):289-97. doi: 10.1093/protein/gzq005. Epub Feb. 11, 2010.

Wu et al., "Development of motavizumab, an ultra-potent antibody for the prevention of respiratory syncytial virus infection in the upper and lower respiratory tract," J. Mol. Biol., May 4, 2007;368(3):652-65. Epub Feb. 20, 2007.

Xu et al., "Fc gamma Rs modulate cytotoxicity of anti-Fas antibodies: implications for agonistic antibody-based therapeutics," J Immunol., 171(2):562-8 (2003).

Yeung et al., "Engineering human IgG1 affinity to human neonatal Fc receptor: impact of affinity improvement on pharmacokinetics in primates," J. Immunol., Jun. 15, 2009;182(12):7663-71.doi: 10.4049/jimmunol.0804182.

Yuasa et al., "Deletion of fcgamma receptor IIB renders H-2(b) mice susceptible to collagen-induced arthritis," J Exp Med., 189(1):187-94 (1999).

Zalevsky et al., "The impact of Fc engineering on an anti-CD19 antibody: increased Fcgamma receptor affinity enhances B-cell clearing in nonhuman primates," Blood, 113(16):3735-43 (2009). Epub Dec. 24, 2008.

Zalevsky et al., "Enhanced antibody half-life improves in vivo activity," Nat Biotechnol., Feb. 2010;28(2):157-9. doi: 10.1038/nbt.1601. Epub Jan. 17, 2010.

Zeidler et al., Simultaneous activation of T cells and accessory cells by a new class of intact bispecific antibody results in efficient tumor cell killing, J Immunol., Aug. 1, 1999;163(3):1246-52.

Zhang et al., "Effective therapy for a murine model of human anaplastic large-cell lymphoma with the anti-CD30 monoclonal antibody, HeFi-1,does not require activating Fc receptors," Blood, Jul. 15, 2006;108(2):705-10. Epub Mar. 21, 2006.

Zhang et al., "Immune complex/Ig negatively regulate TLR4-triggered inflammatory response inmacrophages through Fc gamma RIIb-dependent PGE2 production," J Immunol., Jan. 1, 2009;182(1):554-62.

International Search Report for App. Ser. No. PCT/JP2013/084809, dated Apr. 1, 2014, 4 pages.

International Preliminary Report on Patentability for App. Ser. No. PCT/JP2013/084809, dated Jun. 30, 2015, 7 pages.

International Preliminary Report on Patentability for App. Ser. No. PCT/JP2012/066665, dated Jan. 16, 2014, 10 pages.

International Search Report and Written Opinion for App. Ser. No. PCT/JP2012/066665, dated Sep. 25, 2012, 10 pages.

International Search Report and Written Opinion for App. Ser. No. PCT/JP2012/054624, dated Apr. 3, 2013, 7 pages.

International Preliminary Report on Patentability for App. Ser. No. PCT/JP2012/054624, dated Aug. 27, 2013, 7 pages.

International Search Report for App. Ser. No. PCT/JP2012/075092, dated Dec. 25, 2012, 4 pages.

International Preliminary Report on Patentability for App. Ser. No. PCT/JP2012/075092, dated Apr. 1, 2014, 10 pages.

International Search Report for App. Ser. No. PCT/JP2013/054461, dated May 7, 2013, 7 pages.

International Preliminary Report on Patentability for App. Ser. No. PCT/JP2013/054461, dated Aug. 26, 2014, 6 pages.

International Search Report for App. Ser. No. PCT/JP2013/066428, dated Aug. 6, 2013.

International Preliminary Report on Patentability for App. Ser. No. PCT/JP2013/066428, dated Dec. 16, 2014.

International Search Report for App. Ser. No. PCT/JP2013/072507, dated Oct. 29, 2013, 4 pages.

International Preliminary Report on Patentability for App. Ser. No. PCT/JP2013/072507, dated Feb. 24, 2015, 6 pages.

Atwell et al., "Stable heterodimers from remodeling the domain interface of a homodimer using a phage display library," *J Mol Biol.*, Jul. 4, 1997;270(1)26-35.

Guilliams et al., "The function of Fcγ receptors in dendritic cells and macrophages," *Nat Rev Immunol.*, Feb. 2014;14(2):94-108. doi: 10.1038/nri3582. Epub Jan. 21, 2014.

Marino et al., "Prevention of systemic lupus erythematosus in MRL/lpr mice by administration of an immunoglobulin-binding peptide," *Nat Biotechnol.*, Jul. 2000;18(7):735-9.

Matsumiya et al., "Structural comparison of fucosylated and nonfucosylated Fc fragments of human immunoglobulin G1," *J Mol Biol.*, May 4, 2007;368(3):767-79. Epub Feb. 22, 2007.

Moore et al., "Engineered Fc variant antibodies with enhanced ability to recruit complement and mediate effector functions," *MAbs.*, Mar.-Apr. 2010;2(2):181-9.

Natsume et al., "Engineered antibodies of IgG1/IgG3 mixed isotype with enhanced cytotoxic activities," *Cancer Res.*, May 15, 2008;68(10):3863-72. doi: 10.1158/0008-5472.CAN-07-6297.

Werwitzke et al., "Treatment of lupus-prone NZB/NZW F1 mice with recombinant soluble Fc gamma receptor II (CD32)," *Ann Rheum Dis.*, Feb. 2008;67(2):154-61. Epub Jun. 8, 2007.

Xi et al., "Increased survival and reduced renal injury in MRL/lpr mice treated with a human Fcγ receptor II (CD32) peptide," *Immunology*, May 2012;136(1):46-53. doi: 10.1111/j.1365-2567.2012.03553.x.

Xie et al., "A new format of bispecific antibody: highly efficient heterodimerization, expression and tumor cell lysis," *J Immunol Methods.*, Jan. 2005;296(1-2):95-101. Epub Nov. 19, 2004.

USPTO Restriction Requirement in U.S. Appl. No. 14/127,576, dated Jun. 1, 2016, 8 pages.

Fish & Richardson P.C., Reply to Restriction Requirement dated Jun. 1, 2016 in U.S. Appl. No. 14/127,576, filed on Aug. 24, 2016, 2 pages.

USPTO Non-Final Office Action in U.S. Appl. No. 14/127,576, dated Sep. 20, 2016, 17 pages.

Bruhns, "Properties of mouse and human IgG receptors and their contribution to disease models," *Blood*, Jun. 14, 2012;119(24).5640-9. doi: 10.1182/blood-2012-01-380121. Epub Apr. 25, 2012.

Hjelm et al., "Antibody-mediated regulation of the immune response," *Scand J Immunol*, Sep. 2006;64(3):177-84.

Idusogie et al., "Mapping of the C1q binding site on rituxan, a chimeric antibody with a human IgG1 Fc," *J Immunol*, Apr. 15, 2000;164(8):4178-84.

U.S. Appl. No. 14/001,218, Mimoto et al., filed Dec. 2, 2013.
U.S. Appl. No. 15/860,163, Mimoto et al., filed Jan. 2, 2018.
U.S. Appl. No. 14/377,556, Kuramochi et al., filed Aug. 8, 2014.
U.S. Appl. No. 14/379,825, Igawa et al., filed Aug. 20, 2014.
U.S. Appl. No. 14/347,321, Igawa et al., filed Mar. 26, 2014.
U.S. Appl. No. 15/977,757, Igawa et al., filed May 11, 2018.
U.S. Appl. No. 14/423,269, Katada et al., filed Feb. 23, 2015.
U.S. Appl. No. 14/781,069, Mimoto et al., filed Sep. 29, 2015.
U.S. Appl. No. 14/406,232, Igawa et al., filed Dec. 8, 2014.

Beljaars et al., "The preferential homing of a platelet derived growth factor receptor-recognizing macromolecule to fibroblast-like cells in fibrotic tissue," Biochemical Pharmacology, Oct. 2003, 66(7):1307-17.

Binetruy-Tournaire et al., "Identification of a peptide blocking vascular endothelial growth factor (VEGF)-mediated angiogenesis," EMBO J., Apr. 3, 2000, 19(7):1525-33.

Brennand et al., A cyclic peptide analogue of loop III of PDGF-BB causes an apoptosis in human fibroblasts, FEBS Lett., Dec. 15, 1997, 419(2-3):166-70.

Chamarthy et al., "Gene delivery to dendritic cells facilitated by a tumor necrosis factor alpha-competing peptide," Mol Immunol, Jul. 2004, 41(8):741-9.

Deambrosis et al "Inhibition of CD40-CD154 costimulatory pathway by a cyclic peptide targeting CD154," J Mol Med., Feb. 2009, 87(2): 181-97.

(56) References Cited

OTHER PUBLICATIONS

Faham et al., "Antigen-Containing Liposomes Engrafted with Flagellin-Related Peptides Are Effective Vaccines That Can Induce Potent Antitumor Immunity and Immunotherapeutic Effect," J Immunol., Jul. 7, 2010, 185:1744-1754.

Fillipovic et al., Biochemical basis of human life activity, VLADOS, 2005: 38-43 (with English translation).

Fillipovic et al., Biochemical basis of human life activity, VLADOS, 2005: 49-50 (with English translation).

Hetian et al., "A Novel Peptide Isolated from a Phage Display Library Inhibits Tumor Growth and Metastasis by Blocking the Binding of Vascular Endothelial Growth Factor to Its Kinase Domain Receptor," J Biol Chem., Nov. 8, 2002, 277(45):43137-42.

Kabat et al., "Sequences of proteins of immunological interest", U.S. Department of Health and Human Services, National Institutes of Health, NIH Publication No. 91-3242, 5th ed., 1991, vol. 1, pp. 679-87.

Kraft et al., "Definition of an Unexpected Ligand Recognition Motif for αvβ6 Integrin," J. Biol. Chem., Jan. 22, 1999, 274:1979-1985.

Li et al., Activation of the Proapoptotic Death Receptor DR5 by Oligomeric Peptide and Antibody Agonists, J. Mol. Biol., Aug. 18, 2006, 361(3):522-536.

Maxwell et al., "Crystal structure of the human leukocyte Fc receptor, FcγRIIa," Nat Struct Bio I, May 1999, 6(5):437-42.

Nakamura et al., "Peptide mimics of epidermal growth factor (EGF) with antagonistic activity," Journal of Biotechnology, Mar. 30, 2005, 116(3):211-219.

Rao et al., "Novel cyclic and linear oligopeptides that bind to integrin β1 chain and either inhibit or costimulate T lymphocytes," Int. Immunopharmacol., Mar.2003, 3(3): 435-43.

Richards et al., "A peptide containing a novel FPGN CD40-binding sequence enhances adenoviral infection of murine and human dendritic cells," Eur J Biochem., May 2003, 270(10):2287-94.

Shanmugam et al., "Synthetic Toll Like Receptor-4 (TLR-4) Agonist Peptides as a Novel Class of Adjuvants," PLoS ONE, Feb. 2012, 7(2):e30839.

Sondermann et al., "Molecular Basis for Immune Complex Recognition: A Comparison of Fc-Receptor Structures," J Mol Biol., Jun. 8, 2001, 309(3):737-49.

Sondermann et al., "Crystal structure of the soluble form of the human Fcγ-receptor IIb: a new member of the immunoglobulin superfamily at 1.7 A resolution," EMBO J., Mar. 1, 1999, 18(5):1095-103.

Stepanov, Molecular biology. Structure and functions of proteins. M.: Nauka, 2005, pp. 61-62 (with English translation).

Wu et al., "Structures of the CXCR4 Chemokine GPCR with Small-Molecule and Cyclic Peptide Antagonists," Science, Nov. 19, 2010, 330:1066-1071.

Yarilin, Fundamentals of Immunology. M: Medicina, 1999, p. 169-72, 354-8 (with English translation).

USPTO Non-Final Office Action in U.S. Appl. No. 15/024,063, dated Feb. 7, 2018, 91 pages.

USPTO Applicant-Initiated Interview Summary in U.S. Appl. No. 14/406,232, dated May 15, 2018, 3 pages.

USPTO Final Office Action in U.S. Appl. No. 14/001,218, dated Jan. 29, 2018, 11 pages.

Kamata et al., "Comparison of pH and Ionic Strength Dependence of Interactions between Monoclonal Antibodies and Bovine β-Lactoglobulin," Biosci Biotechnol Biochem, Jan. 1996, 60(1):25-9.

Maccullum et al., "Antibody-antigen Interactions: Contact Analysis and Binding Site Topography," J Mol Biol, Oct. 11, 1996, 262:732-745.

Vajdos et al., "Comprehensive Functional Maps of the Antigen-binding Site of an Anti-ErbB2 Antibody Obtained with Shotgun Scanning Mutagenesis," J Mol Biol, Jul. 5, 2002, 320:415-428.

USPTO Non-Final Office Action in U.S. Appl. No. 14/001,218, dated Mar. 18, 2019, 32 pages.

Zhang et al., "Intratumoral Epiregulin is a Marker of Advanced Disease in Non-Small Cell Lung Cancer Patients and Confers Invasive Properties on EGFR-Mutant Cells," Cancer Prev Res (Phila), Aug. 2008, 1(3):201-7. doi: 10.1158/1940-6207.CAPR-08-0014. Epub Mar. 31, 2008.

USPTO Final Office Action in U.S. Appl. No. 14/406,232, dated Apr. 5, 2019, 38 pages.

USPTO Advisory Action in U.S. Appl. No. 14/001,218, dated Apr. 11, 2018, 3 pages.

Bonvin et al., "De novo isolation of antibodies with pH-dependent binding properties," mAbs, Mar.-Apr. 2015, 7(2): 294-302.

Chaparro-Riggers et al., "Increasing serum half-life and extending cholesterol lowering in vivo by engineering antibody with pH-sensitive binding to PCSK9," J Biol Chem, Mar. 30, 2012, 287(14):11090-11097. doi: 10.1074/jbc.M111.319764. Epub Jan. 31, 2012.

Examination Report No. 1 for AU 2013306700 (IP Australia) dated Jun. 7, 2018, 3 pages.

Jaeger, Clinical Immunology and Allergology, M.: Meditsina, 1990, 2nd Edition, 2:484-5 (with English translation).

Murtaugh et al., "A Combinatorial Histidine Scanning Library Approach to Engineer Highly pH-Dependent Protein Switches," Protein Sci, Sep. 2011, 20(9):1619-31. doi: 10.1002/pro.696. Epub Aug. 3, 2011.

Sazinsky et al., "Aglycosylated immunoglobulin Gi variants productively engage activating Fc receptors," Proc Natl Acad Sci USA, Dec. 23, 2008, 105(51):20167-72. doi:10.1073/pnas. 0809257105. Epub Dec. 12, 2008.

Schro Ier et al., "A generic approach to engineer antibody pH-switches using combinatorial histidine scanning libraries and yeast display," mAbs, Jan.-Feb. 2015, 7(1):138-151. doi: 10.4161/19420862. 2014.985993.

Travis et al., "Isolation of Albumin from Whole Human Plasma and Fractionation of Albumin-Depleted Plasma," Biochem J, Aug. 1, 1976, 157(2):301-6.

Weiss et al., "Rapid mapping of protein functional epitopes by combinatorial alanine scanning," Proc Natl Acad Sci USA, Aug. 1, 2008 97(16):8950-4.

Yarilin, Fundamentals of Immunology, M.: Meditsina, 1999, pp. 181-4 (with English translation).

USPTO Non-Final Office Action for U.S. Appl. No. 14/422,207, dated Jun. 18, 2019, 43 pages.

Diamond et al., "Somatic mutation of the T15 heavy chain gives rise to an antibody with autoantibody specificity," Proc Natl Acad Sci USA, Sep. 1984, 81(18):5841-4.

Hasemann et al., "Mutational Analysis of Arsonate Binding by a $CRI_{A+}$Antibody—$V_H$ and $V_L$ Junctional Diversity are Essential for Binding Activity," J Biol Chem, Apr. 25, 1191, 266(12):762632.

Ohno et al., "Antigen-binding specificities of antibodies are primarily determined by seven residues of $V_H$," Proc Natl Acad Sci USA, May 1985, 82(9):2945-9.

King, Applications and Engineering of Monoclonal Antibodies, CRC Press, 1998, pp. 2, 13-14.

Roitt et al., Immunology, Moscow, Mir, 2000, p. 110 (with English translation).

Roitt et al., Immunology, Moscow, Mir, 2000, p. 9 (with English translation).

Schlothauer et al., "Novel human IgG1 and IgG4 Fc-engineered antibodies with completely.abolished immune effector functions," Protein Eng Des Sel, Oct. 2016, 29(10):457-466. doi: 10.1093/protein/gzw040. Epub Aug. 29, 2016.

Yarilin, Fundamentals of Immunology, Moscow: Medicina, 1999, pp. 172-4 (with English translation).

Examiner Chun Wu Dahle, USPTO Final Office Action in U.S. Appl. No. 14/001,218, dated Nov. 21, 2019, 17 pages.

* cited by examiner

HETERODIMERIZED POLYPEPTIDE

CROSS-REFERENCE TO RELATED APPLICATIONS

This application is the National Stage of International Application Serial No. PCT/JP2013/084809, filed on Dec. 26, 2013, which claims the benefit of Japanese Application Serial No. 2012-284129, filed on Dec. 27, 2012.

TECHNICAL FIELD

The present invention provides antibody constant regions whose amino acid sequence is modified from a naturally-occurring antibody constant region, antibodies comprising such constant regions, pharmaceutical compositions comprising such antibodies, and methods for producing them.

BACKGROUND ART

Antibodies are drawing attention as pharmaceuticals since they are highly stable in blood and have few side effects (Non-patent Documents 1 and 2). Almost all antibody pharmaceuticals currently on the market are antibodies of the human IgG1 subclass. So far, many studies have been carried out on antibody-dependent cellular cytotoxicity (hereinafter, referred to as ADCC) and complement-dependent cytotoxicity (hereinafter, referred to as CDC) which are effector functions of the IgG class antibodies; and in human IgG class, antibodies of the IgG1 subclass have been reported to have the highest ADCC activity and CDC activity (Non-patent Document 3). Furthermore, antibody-dependent cell-mediated phagocytosis (ADCP), which is phagocytosis of target cells mediated by IgG class antibodies, is also shown as one of the antibody effector functions (Non-patent Documents 4 and 5).

For an IgG antibody to exhibit ADCC, CDC, or ADCP, the antibody Fc region must bind to an antibody receptor which is present on the surface of effector cells such as killer cells, natural killer cells, and activated macrophages (hereinafter denoted as FcγR) and various complement components. In humans, the FcγRIa, FcγRIIa, FcγRIIb, FcγRIIIa, and FcγRIIIb isoforms have been reported as the FcγR protein family, and the respective allotypes have also been reported (Non-patent Document 6).

Enhancement of cytotoxic effector functions such as ADCC, ADCP, and CDC is drawing attention as a promising means for enhancing the anti-tumor effects of antibodies. The importance of FcγR-mediated effector functions of antibodies for their antitumor effects has been reported using mouse models (Non-patent Documents 7 and 8). Furthermore, correlation was observed between clinical effects in humans and the high-affinity polymorphic allotype (V158) and the low-affinity polymorphic allotype (F158) of FcγRIIIa (Non-patent Document 9). These reports showed that antibodies having an Fc region that has been optimized for specific FcγR-binding mediate a stronger effector function, as a result demonstrate more effective antitumor effects.

The balance between the binding activities of an antibody towards an activating receptor consisted of FcγRIa, FcγRIIa, FcγRIIIa, and FcγRIIIb, and an inhibitory receptor consisted of FcγRIIb is an important element when optimizing antibody effector function. Use of an Fc region that enhances binding activity to activating receptors and decreases binding activity to inhibitory receptors may be able to confer antibodies with optimum effector functions (Non-patent Document 10). Conversely, use of an Fc region that has sustained or decreased binding activity to activating receptors and enhanced binding activity to inhibitory receptors may be able to confer immunosuppressive effect to antibodies (Non-patent Document 11). For the binding between an Fc region and FcγR, several amino acid residues in the antibody hinge region and CH2 domain, and the sugar chain added to Asn at position 297 (EU numbering) which is bound to the CH2 domain have been shown to be important for the binding between the Fc region and FcγR (Non-patent Documents 12, 13, and 14). There has been research on Fc region variants that have various FcγR-binding properties mainly at this binding site, and Fc region variants that have higher binding activities to activating FcγR have been obtained (Patent Documents 1 and 2). For example, Lazar et al. have successfully increased human FcγRIIIa (V158) binding approximately 370-fold by substituting Ser at position 239, Ala at position 330, and Ile at position 332 (EU numbering) of human IgG1 with Asp, Leu, and Glu, respectively (Non-patent Document 15 and Patent Document 2). The ratio of FcγRIIIa-binding to FcγRIIb-binding (A/I ratio) of this variant is increased approximately 9-fold as compared to that of the wild type. Furthermore, Lazar et al. have successfully enhanced the binding to FcγRIIb approximately 430-fold (Non-patent Document 16). Shinkawa et al. have successfully enhanced the FcγRIIIa-binding approximately 100-fold by removing fucose from the sugar chain added to Asn at position 297 (EU numbering) (Non-patent Document 17).

In the above-mentioned method, the same amino acid alterations or the same sugar-chain modifications are introduced into both H-chain Fc regions of an antibody. Meanwhile, the antibody Fc region has been reported to show 1:1 binding with FcγR and recognize FcγR asymmetrically in the lower hinge and CH2 region (Non-patent Document 18). Taking into account the asymmetric interaction between the Fc region and FcγR, one may consider optimizing the interaction between IgG and FcγR more finely by introducing different alteration(s) into each of the H chains. Methods for optimizing the interaction with FcγR by asymmetrically modifying the Fc region through introduction of different alterations into each of the H-chain Fc regions of the antibody based on this idea have been reported (Patent Documents 5 and 6). However, asymmetrically-optimized Fc regions do not necessarily show excellent FcγRIIIa-binding activity in comparison to symmetrically-optimized Fc regions (Patent Document 5). Depending on the type of alterations introduced, asymmetrical optimization of the Fc region has successfully enhanced the binding to FcγRIIIa by several tens of times compared to those of a native IgG and enhanced the ADCC activity. However, on the other hand, the ADCC activity is about the same or even weaker than that of an afucosylated antibody where fucose is removed from the N-type sugar chain of both H chains, which was produced by using conventional technology (Patent Document 6).

PRIOR ART DOCUMENTS

Patent Documents

[Patent Document 1] WO 2000/042072
[Patent Document 2] WO 2006/019447
[Patent Document 3] WO 2009/041062
[Patent Document 4] WO 2006/106905
[Patent Document 5] WO 2012/058768
[Patent Document 6] WO 2012/125850

Non-patent Documents

[Non-patent Document 1] Nature Biotechnology, 23, 1073-1078 (2005)
[Non-patent Document 2] Eur. J. Pharm. Biopharm, 59(3), 389-96 (2005)
[Non-patent Document 3] Chemical Immunology, 65, 88 (1997)
[Non-patent Document 4] Cancer Res., 68, 8049-8057 (2008)
[Non-patent Document 5] Blood, 113, 3735-3743 (2009)
[Non-patent Document 6] Immunol. Lett. 82, 57-65 (2002)
[Non-patent Document 7] Pro. Nat. Acad. Sci. 95: 652-656 (1998)
[Non-patent Document 8] Nature Medicine, 6: 443-446 (2000)
[Non-patent Document 9] Blood 99:754-758 (2002)
[Non-patent Document 10] Science, 310, 1510-1512 (2005)
[Non-patent Document 11] Science, 291, 484-486 (2001)
[Non-patent Document 12] Chemical Immunology, 65, 88 (1997)
[Non-patent Document 13] Eur. J. Immunol. 23, 1098 (1993)
[Non-patent Document 14] Immunology, 86, 319 (1995)
[Non-patent Document 15] Pro. Nat. Acad. Sci., 103, 4005-4010 (2006)
[Non-patent Document 16] Mol. Immun. 45, 3926-3933 (2008)
[Non-patent Document 17] J. Biol. Chem., 278, 3466-3473 (2003)
[Non-patent Document 18] J. Biol. Chem., 276: 16469-16477 (2001)

SUMMARY OF THE INVENTION

Problems to be Solved by the Invention

The present invention was achieved in view of the above circumstances. An objective of the present invention is to provide polypeptides with improved Fc region function over conventional homodimerized polypeptides having an Fc region; pharmaceutical compositions comprising the polypeptides; therapeutic agents or preventive agents for immunoinflammatory diseases comprising the pharmaceutical compositions; therapeutic agents or preventive agents for various types of cancers; and methods for producing them. Furthermore, an objective of the present invention is to provide methods of improving the Fc region function compared to that of a conventional homodimerized polypeptide having an Fc region.

Means for Solving the Problems

The present inventors performed dedicated research to solve the above-mentioned problems. As a result, the present inventors produced heterodimerized polypeptides having an Fc region consisting of two polypeptides with different amino acid sequences (a first polypeptide and a second polypeptide), and successfully produced heterodimerized polypeptides comprising an Fc region with improved function over conventional homodimers in which the Fc region is composed of only the first polypeptide or only the second polypeptide.

More specifically, the present invention provides [1] to [21] below:
[1] a polypeptide characterized in that the polypeptide is composed of a heterodimer comprising a first polypeptide and a second polypeptide, wherein either one of the first polypeptide and the second polypeptide comprises an Fc region introduced with the mutations of (i) or (ii), which is a polypeptide whose function of the Fc region is altered compared to a polypeptide comprising an Fc region without mutations:

(i) according to EU numbering, the amino acid at position 234 is L, S, F, E, V, D, Q, I, M, T, A, G, or H; the amino acid at position 235 is Y or Q; the amino acid at position 236 is W; the amino acid at position 239 is M or I; the amino acid at position 268 is D; and the amino acid at position 298 is A;

(ii) according to EU numbering, the amino acid at position 270 is E; the amino acid at position 326 is D; the amino acid at position 330 is A, K, M, F, I, Y, or H; and the amino acid at position 334 is E;

[2] the polypeptide of [1], wherein either the first polypeptide or the second polypeptide comprises an Fc region introduced with the mutations of (i) or (ii), and the mutations of (iii) are introduced into the other polypeptide:

(i) according to EU numbering, the amino acid at position 234 is L, S, F, E, V, D, Q, I, M, T, A, G or H; the amino acid at position 235 is Y or Q; the amino acid at position 236 is W; the amino acid at position 239 is M or I; the amino acid at position 268 is D; the amino acid at position 298 is A; and the amino acid at position 327 is D;

(ii) according to EU numbering, the amino acid at position 234 is L, S, F, E, V, D, Q, I, M, T, A, G or H; the amino acid at position 235 is Y or Q; the amino acid at position 236 is W; the amino acid at position 239 is M or I; the amino acid at position 268 is D; the amino acid at position 270 is E; and the amino acid at position 298 is A;

(iii) according to EU numbering, the amino acid at position 270 is E; the amino acid at position 326 is D; the amino acid at position 330 is A, K, M, F, I, Y, or H; and the amino acid at position 334 is E;

[3] the polypeptide of [2], wherein in [2] (i), the amino acid at position 234 according to EU numbering is E, D, T, or L;
[4] the polypeptide of [2], wherein in [2] (ii), the amino acid at position 234 according to EU numbering is L, F, E, or D;
[5] the polypeptide of [2], wherein in [2] (i), the amino acid at position 234 according to EU numbering is V, I, T, M, or L;
[6] the polypeptide of [2], wherein in [2] (i), the amino acid at position 234 according to EU numbering is V, E, D, T, I, L, or F, and the amino acid at position 239 is M or I; and in (iii), the amino acid at position 330 according to EU numbering is A or K;
[7] the polypeptide of [2], wherein in [2] (ii), the amino acid at position 234 according to EU numbering is F, E, D, S, or L, and the amino acid at position 239 is M or I; and in (iii), the amino acid at position 330 according to EU numbering is A, F, or K;
[8] the polypeptide of any one of [1] to [7], wherein the alteration of function of the Fc region is at least one or more alterations selected from the group consisting of enhancement of binding activity, weakening of binding activity, and improvement of selectivity of binding activity of the polypeptide to an Fcγ receptor(s);
[9] the polypeptide of [8], wherein the Fcγ receptor(s) is at least one or more receptors selected from the group consisting of FcγRIa, FcγRIIa R, FcγRIIa H, FcγRIIb, FcγRIIIaF, and FcγRIIIaV;

[10] the polypeptide of [8] or [9], wherein the alteration of function of the Fc region is improvement of selectivity of binding activity to an Fcγ receptor(s);

[11] the polypeptide of [10], wherein the improvement of selectivity of binding activity to an Fcγ receptor(s) refers to selectivity between an activating Fcγ receptor(s) and an inhibitory Fcγ receptor;

[12] the polypeptide of [11], wherein among the aforementioned Fcγ receptors, the activating Fcγ receptor(s) is at least one or more receptors selected from the group consisting of FcγRIa, FcγRIIa R, FcγRIIa H, FcγRIIIaF, and FcγRIIIaV, and the inhibitory Fcγ receptor is FcγRIIb;

[13] the polypeptide of [11] or [12], wherein the binding activity to the activating Fcγ receptor(s) is selectively enhanced compared to the binding activity to the inhibitory Fcγ receptor;

[14] the polypeptide of any one of [1] to [13], wherein an amino acid alteration for conferring difference to the isoelectric points of the first polypeptide and the second polypeptide is further introduced;

[15] the polypeptide of [14], wherein the amino acid alteration for conferring difference to isoelectric points is characterized by the introduction of at least one amino acid mutation at an amino acid site selected from the group consisting of Gly at position 137, Gly at position 138, Thr at position 139, Lys at position 147, Ser at position 192, Leu at position 193, Gln at position 196, Tyr at position 198, Ile at position 199, Asn at position 203, Lys at position 214, Ala at position 231, Glu at position 233, Leu at position 242, Val at position 263, Glu at position 272, Lys at position 274, Tyr at position 278, Lys at position 288, Lys at position 290, Gly at position 316, Lys at position 317, Lys at position 320, Lys at position 324, Thr at position 335, Ser at position 337, Lys at position 338, Lys at position 340, Gly at position 341, Leu at position 358, Lys at position 360, Gln at position 362, Ser at position 364, Ser at position 383, Asn at position 384, Gly at position 385, Gln at position 386, Pro at position 387, Asn at position 390, Val at position 397, and Val at position 422 (EU numbering) in the amino acid sequence of the first polypeptide and/or the second polypeptide;

[16] the polypeptide of [15], wherein the amino acid alteration for conferring difference to isoelectric points is characterized by the introduction of a mutation to at least one amino acid selected from the group consisting of Gln at position 196, Ile at position 199, Ala at position 231, Glu at position 233, Leu at position 242, Val at position 263, Glu at position 272, Gly at position 316, Leu at position 358, Ser at position 364, Ser at position 383, Pro at position 387, and Val at position 397 (EU numbering) in the amino acid sequence of either polypeptide of the first polypeptide or the second polypeptide; and introduction of a mutation to at least one amino acid selected from the group consisting of Gly at position 137, Gly at position 138, Thr at position 139, Lys at position 147, Ser at position 192, Leu at position 193, Tyr at position 198, Ile at position 199, Asn at position 203, Lys at position 214, Lys at position 274, Tyr at position 278, Lys at position 288, Lys at position 290, Gly at position 316, Lys at position 317, Lys at position 320, Lys at position 324, Thr at position 335, Ser at position 337, Lys at position 338, Lys at position 340, Gly at position 341, Leu at position 358, Lys at position 360, Gln at position 362, Ser at position 383, Asn at position 384, Gly at position 385, Gln at position 386, Asn at position 390, and Val at position 422 (EU numbering) in the amino acid sequence of the other polypeptide;

[17] the polypeptide of any one of [1] to [16], wherein the polypeptide is an antigen-binding molecule;

[18] the polypeptide of [17], wherein the antigen-binding molecule is an antibody, a bispecific antibody, or an Fc fusion molecule such as a peptide Fc fusion protein or scaffold Fc fusion protein;

[19] a pharmaceutical composition comprising the polypeptide of any one of [1] to [18] and a medically acceptable carrier;

[20] a method for altering the function of a polypeptide comprising an Fc region, which comprises the steps of heterodimerizing the Fc region by introducing the amino acid mutation(s) according to any one of [1] to [7] into the first polypeptide and/or the second polypeptide constituting the Fc region, and introducing an amino acid mutation(s) to alter the Fc region function compared to when the Fc region forms a homodimer;

[21] a method for producing a polypeptide comprising an Fc region, which comprises the steps of heterodimerizing the Fc region by introducing the amino acid mutation(s) according to any one of [1] to [7] into the first polypeptide and/or the second polypeptide constituting the Fc region, and introducing an amino acid mutation(s) to alter the Fc region function compared to when the Fc region forms a homodimer;

[22] a method for treating or preventing cancer, which comprises the step of administering to a subject the polypeptide of any one of [1] to [18] or the pharmaceutical composition of [19];

[23] the polypeptide of any one of [1] to [18] or the pharmaceutical composition of [19] for use in treatment or prevention of cancer;

[24] use of the polypeptide of any one of [1] to [18] or the pharmaceutical composition of [19] in producing a therapeutic agent or a preventive agent for cancer; and

[25] a process for producing a therapeutic agent or preventive agent for cancer, which comprises the step of using the polypeptide of any one of [1] to [18] or the pharmaceutical composition of [19].

B3/GpL16-k0 (SEQ ID NOs: 4 and 5), and GpH7-A5/ GpL16-k0 (SEQ ID NO: 3 and 5).

Figure 6:
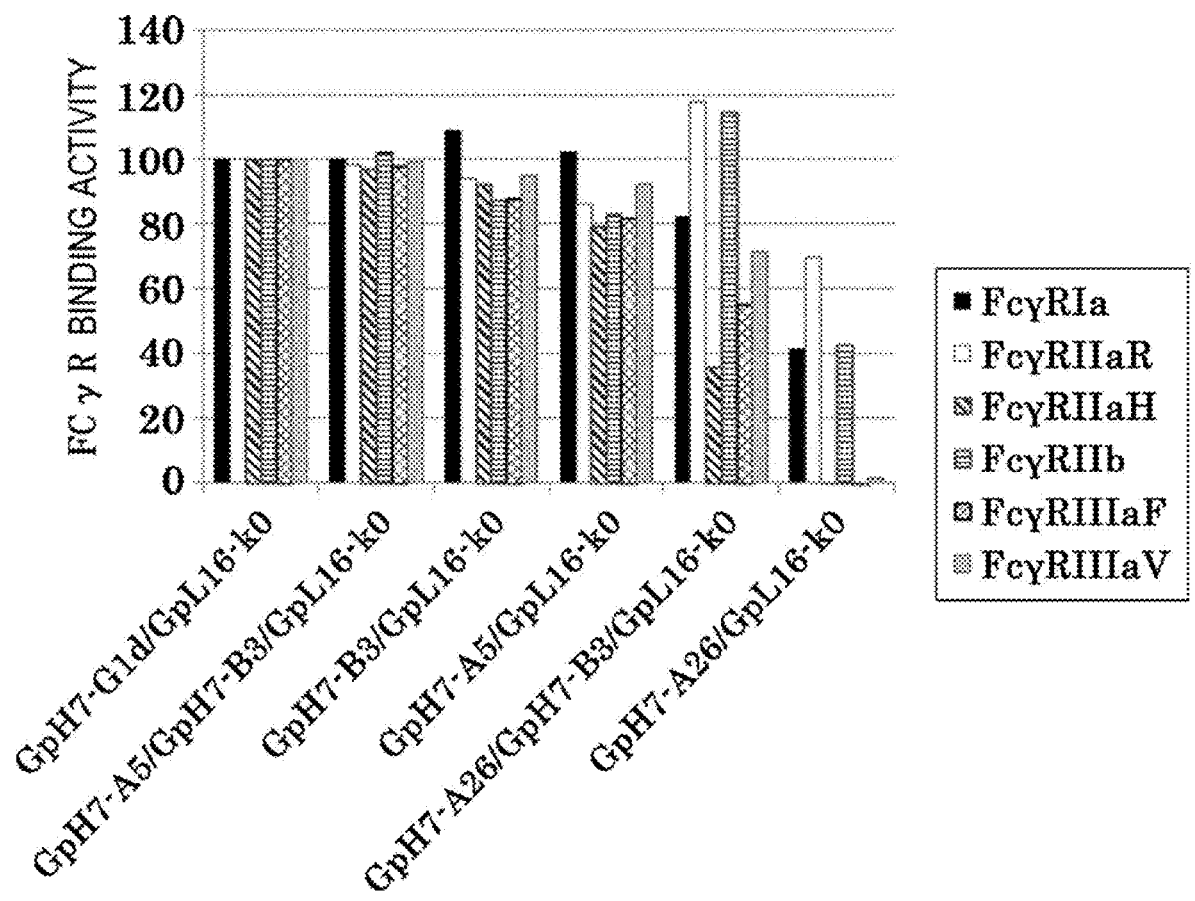

FIG. 6 shows comparison of FcγR-binding activities of antibodies into which G237A has been introduced. The binding activity of GpH7-G1d/GpL16-k0 (SEQ ID NOs: 2 and 5) to each FcγR was defined as 100. The samples used for the evaluation and their sequences were GpH7-G1d/ GpL16-k0 (SEQ ID NOs: 2 and 5), GpH7-A5/GpH7-B3/ GpL16-k0 (SEQ ID NOs: 3, 4, and 5), GpH7-B3/GpL16-k0 (SEQ ID NOs: 4 and 5), GpH7-A5/GpL16-k0 (SEQ ID NOs: 3 and 5), GpH7-A26/GpH7-B3/GpL16-k0 (SEQ ID NOs: 6, 4, and 5), and GpH7-A26/GpL16-k0 (SEQ ID NOs: 6 and 5).

Figure 7:
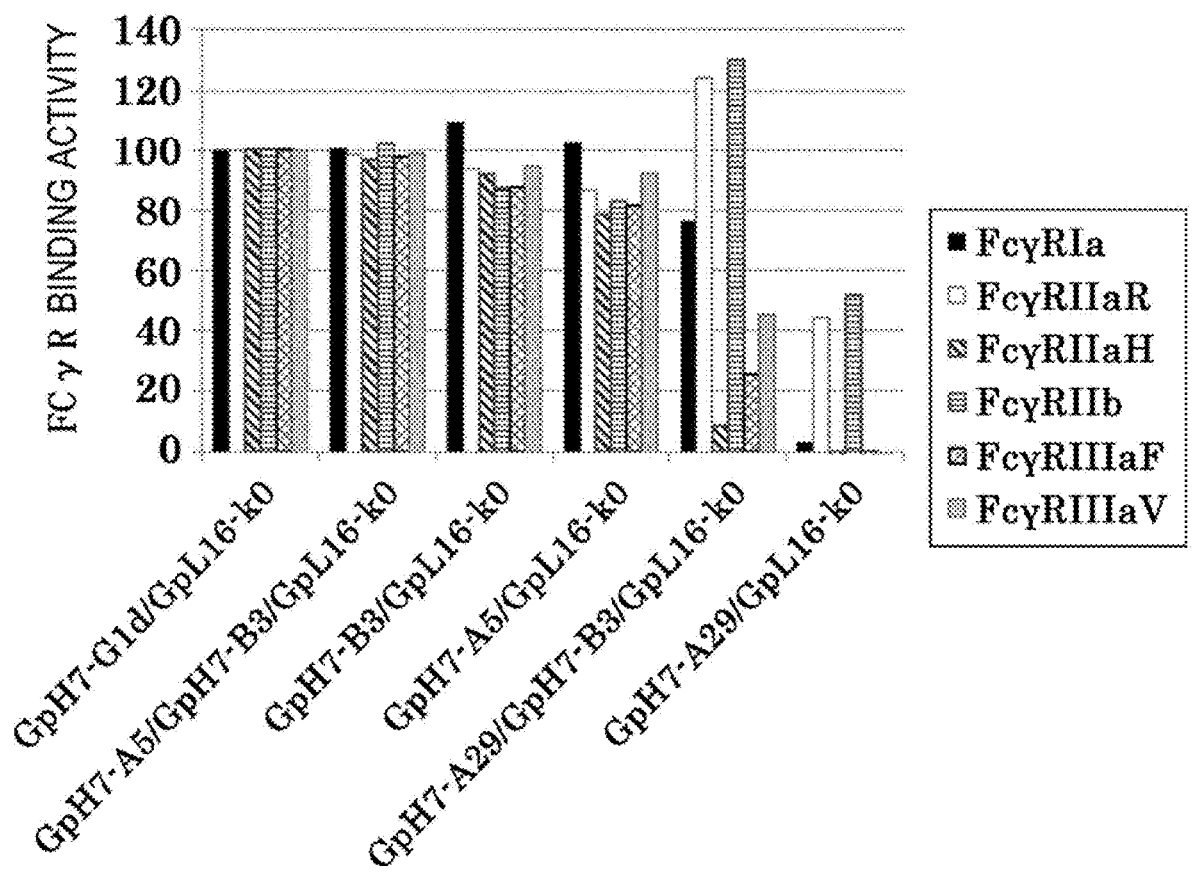

FIG. 7 shows comparison of FcγR-binding activities of homodimerized antibodies and heterodimerized antibodies into which G237L has been introduced. The binding activity of GpH7-G1d/GpL16-k0 (SEQ ID NOs: 2 and 5) to each FcγR was defined as 100. The samples used for the evaluation and their sequences were GpH7-G1d/GpL16-k0 (SEQ ID NOs: 2 and 5), GpH7-A5/GpH7-B3/GpL16-k0 (SEQ ID NOs: 3, 4, and 5), GpH7-B3/GpL16-k0 (SEQ ID NOs: 4 and 5), GpH7-A5/GpL16-k0 (SEQ ID NO: 3 and 5), GpH7-A29/ GpH7-B3/GpL16-k0 (SEQ ID NOs: 7, 4, and 5), and GpH7-A29/GpL16-k0 (SEQ ID NOs: 7 and 5).

Figure 8:
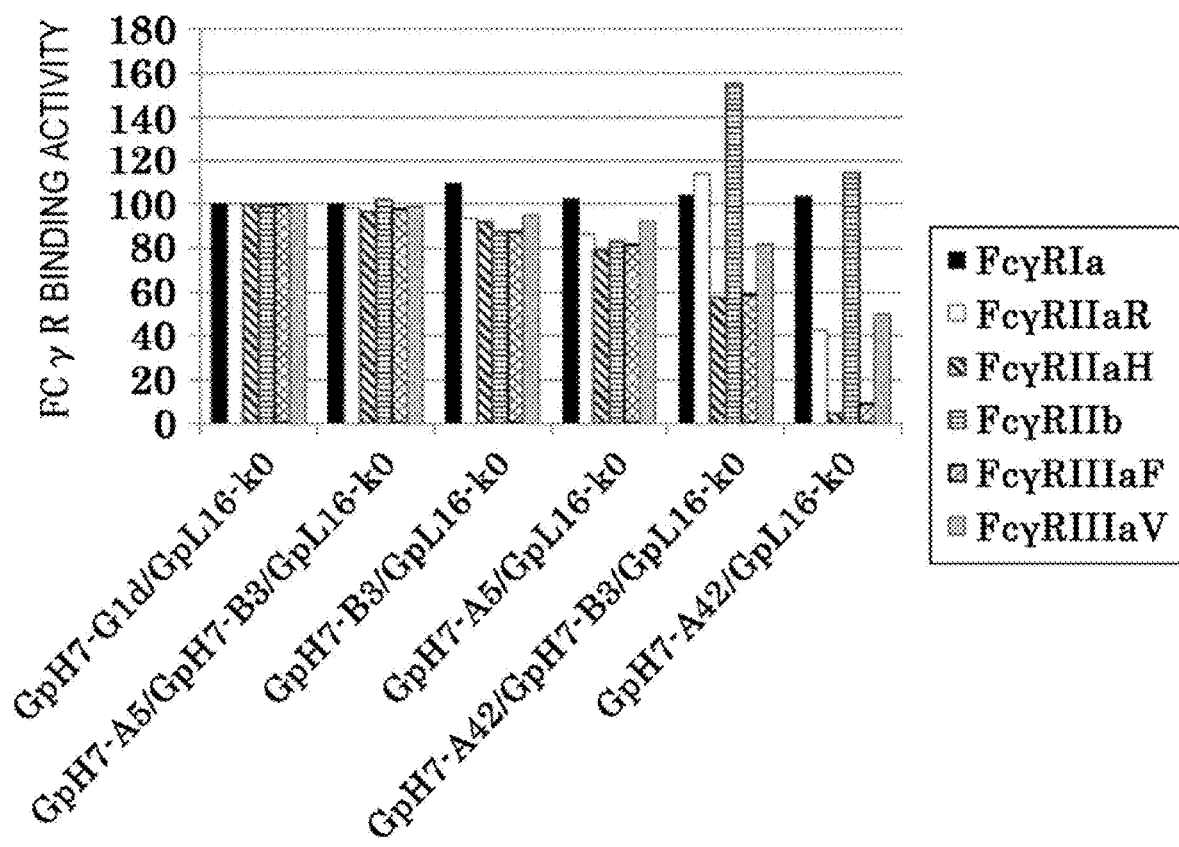

FIG. 8 shows comparison of FcγR-binding activities of homodimerized antibodies and heterodimerized antibodies into which L328E has been introduced. The binding activity of GpH7-G1d/GpL16-k0 (SEQ ID NOs: 2 and 5) to each FcγR was defined as 100. The samples used for the evaluation and their sequences were GpH7-G1d/GpL16-k0 (SEQ ID NOs: 2 and 5), GpH7-A5/GpH7-B3/GpL16-k0 (SEQ ID NOs: 3, 4, and 5), GpH7-B3/GpL16-k0 (SEQ ID NOs: 4 and 5), GpH7-A5/GpL16-k0 (SEQ ID NO: 3 and 5), GpH7-A42/ GpH7-B3/GpL16-k0 (SEQ ID NOs: 8, 4, and 5), and GpH7-A42/GpL16-k0 (SEQ ID NOs: 8 and 5).

Figure 9:
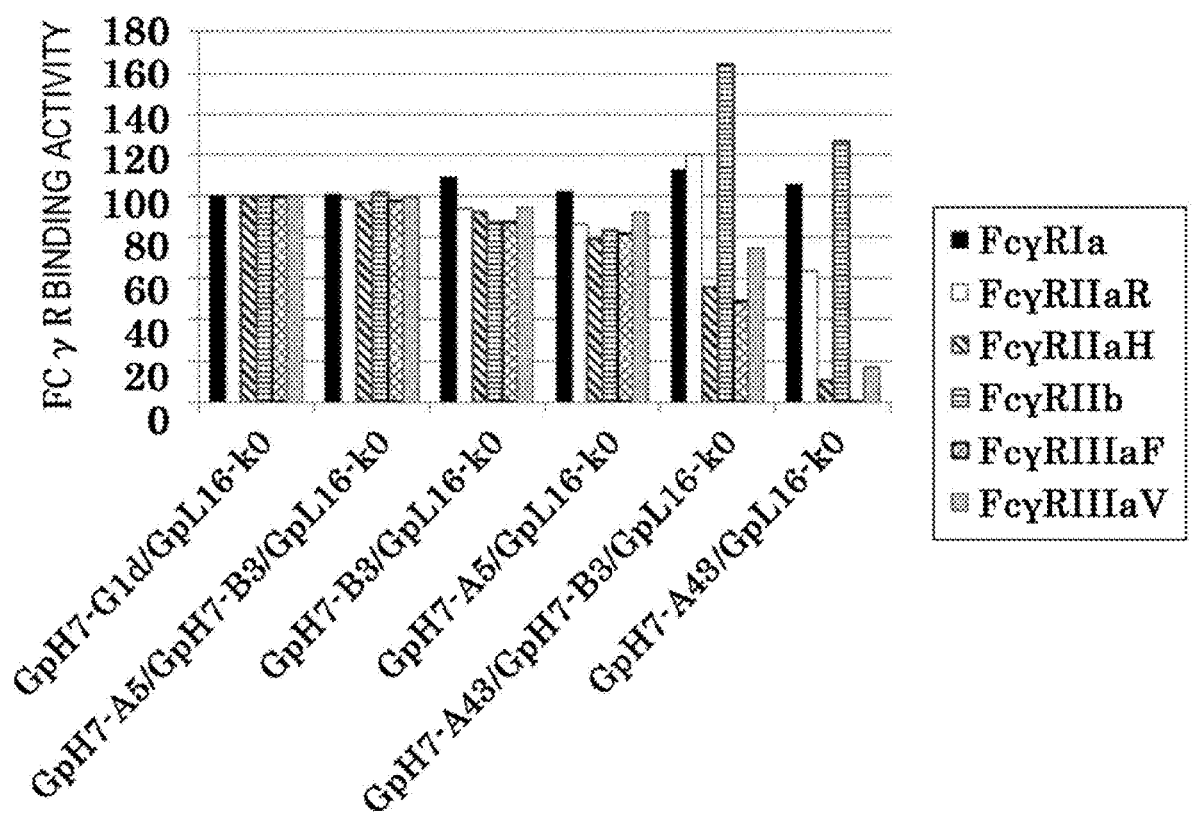

FIG. 9 shows comparison of FcγR-binding activities of homodimerized antibodies and heterodimerized antibodies into which L328D has been introduced. The binding activity of GpH7-G1d/GpL16-k0 (SEQ ID NOs: 2 and 5) to each FcγR was defined as 100. The samples used for the evaluation and their sequences were GpH7-G1d/GpL16-k0 (SEQ ID NOs: 2 and 5), GpH7-A5/GpH7-B3/GpL16-k0 (SEQ ID NOs: 3, 4, and 5), GpH7-B3/GpL16-k0 (SEQ ID NOs: 4 and 5), GpH7-A5/GpL16-k0 (SEQ ID NO: 3 and 5), GpH7-A43/ GpH7-B3/GpL16-k0 (SEQ ID NOs: 9, 4, and 5), and GpH7-A43/GpL16-k0 (SEQ ID NOs: 9 and 5).

Figure 10:
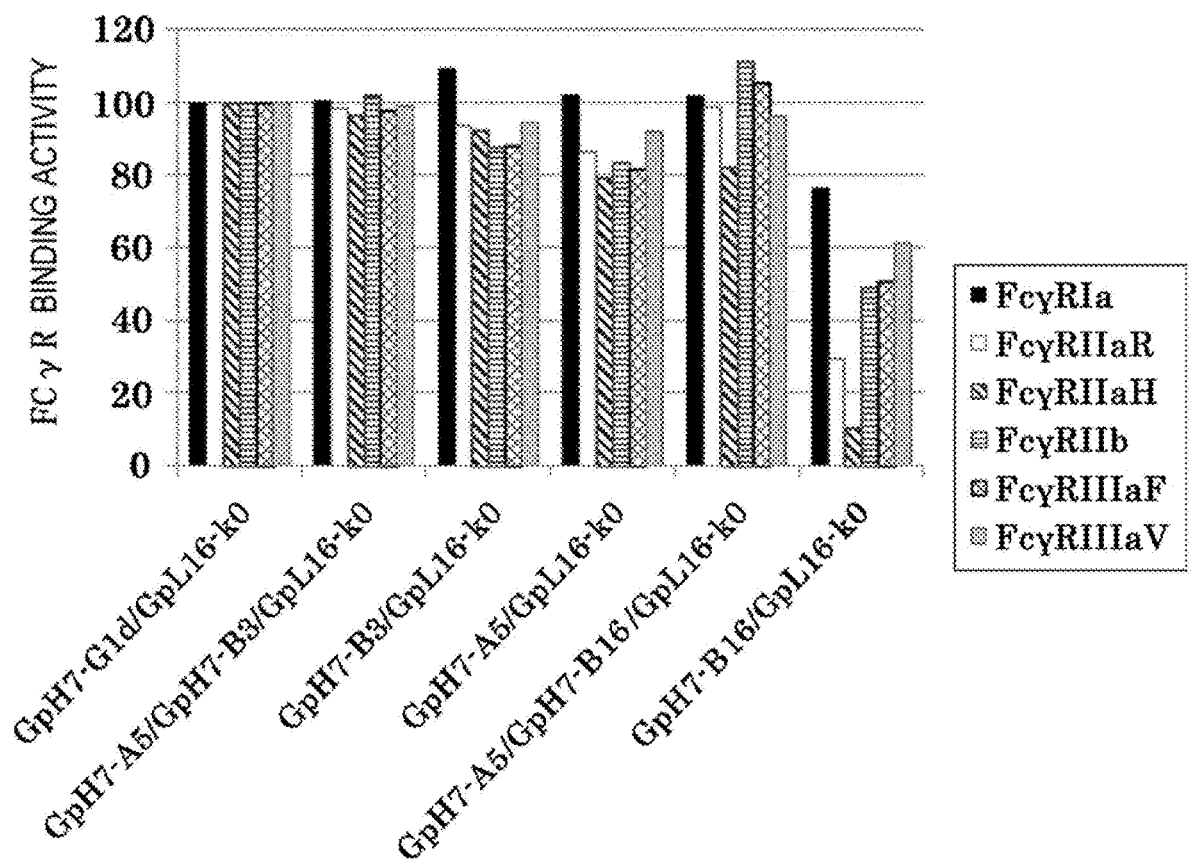

FIG. 10 shows comparison of FcγR-binding activities of homodimerized antibodies and heterodimerized antibodies into which L234E has been introduced. The binding activity of GpH7-G1d/GpL16-k0 (SEQ ID NOs: 2 and 5) to each FcγR was defined as 100. The samples used for the evaluation and their sequences were GpH7-G1d/GpL16-k0 (SEQ ID NOs: 2 and 5), GpH7-A5/GpH7-B3/GpL16-k0 (SEQ ID NOs: 3, 4, and 5), GpH7-B3/GpL16-k0 (SEQ ID NOs: 4 and 5), GpH7-A5/GpL16-k0 (SEQ ID NO: 3 and 5), GpH7-A5/ GpH7-B16/GpL16-k0 (SEQ ID NOs: 3, 10, and 5), and GpH7-B16/GpL16-k0 (SEQ ID NOs: 10 and 5).

Figure 11:
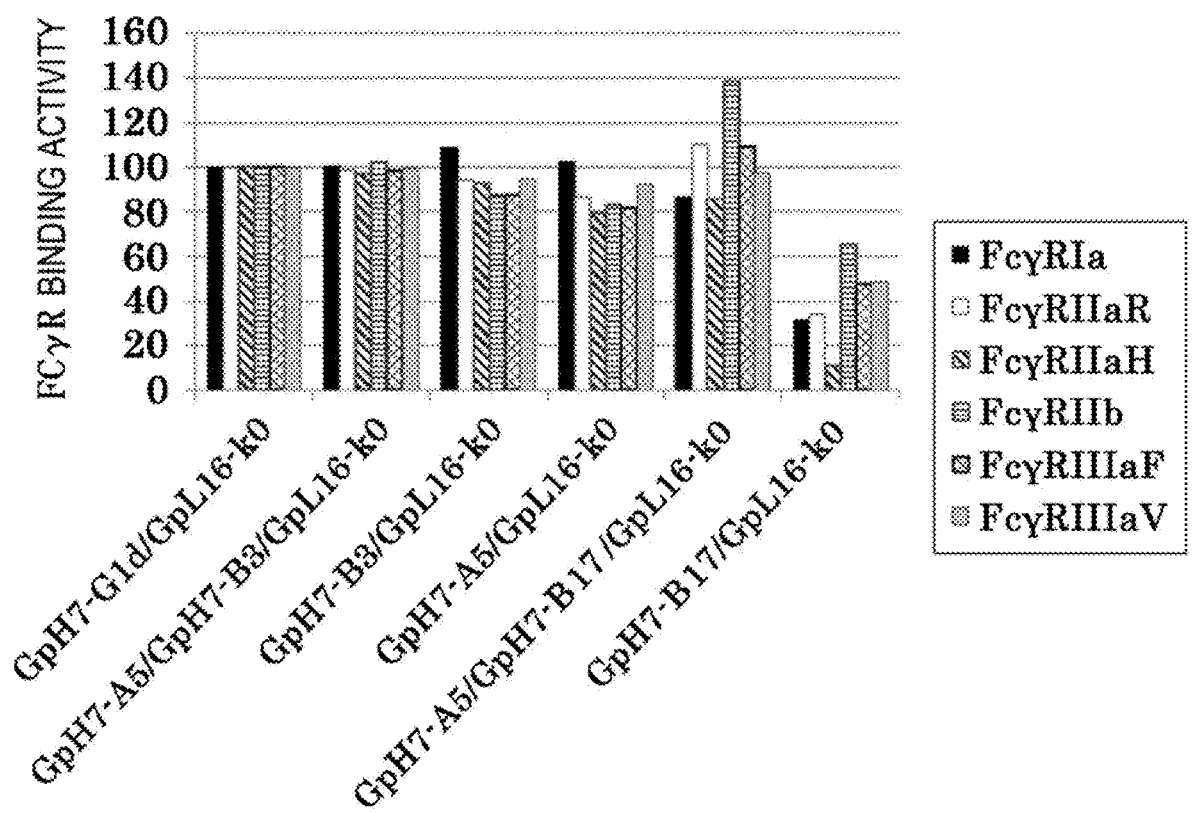

FIG. 11 shows comparison of FcγR-binding activities of homodimerized antibodies and heterodimerized antibodies into which L234D has been introduced. The binding activity of GpH7-G1d/GpL16-k0 (SEQ ID NOs: 2 and 5) to each FcγR was defined as 100. The samples used for the evaluation and their sequences were GpH7-G1d/GpL16-k0 (SEQ ID NOs: 2 and 5), GpH7-A5/GpH7-B3/GpL16-k0 (SEQ ID NOs: 3, 4, and 5), GpH7-B3/GpL16-k0 (SEQ ID NOs: 4 and 5), GpH7-A5/GpL16-k0 (SEQ ID NO: 3 and 5), GpH7-A5/ GpH7-B17/GpL16-k0 (SEQ ID NOs: 3, 11, and 5), and GpH7-B17/GpL16-k0 (SEQ ID NOs: 11 and 5).

Figure 12:
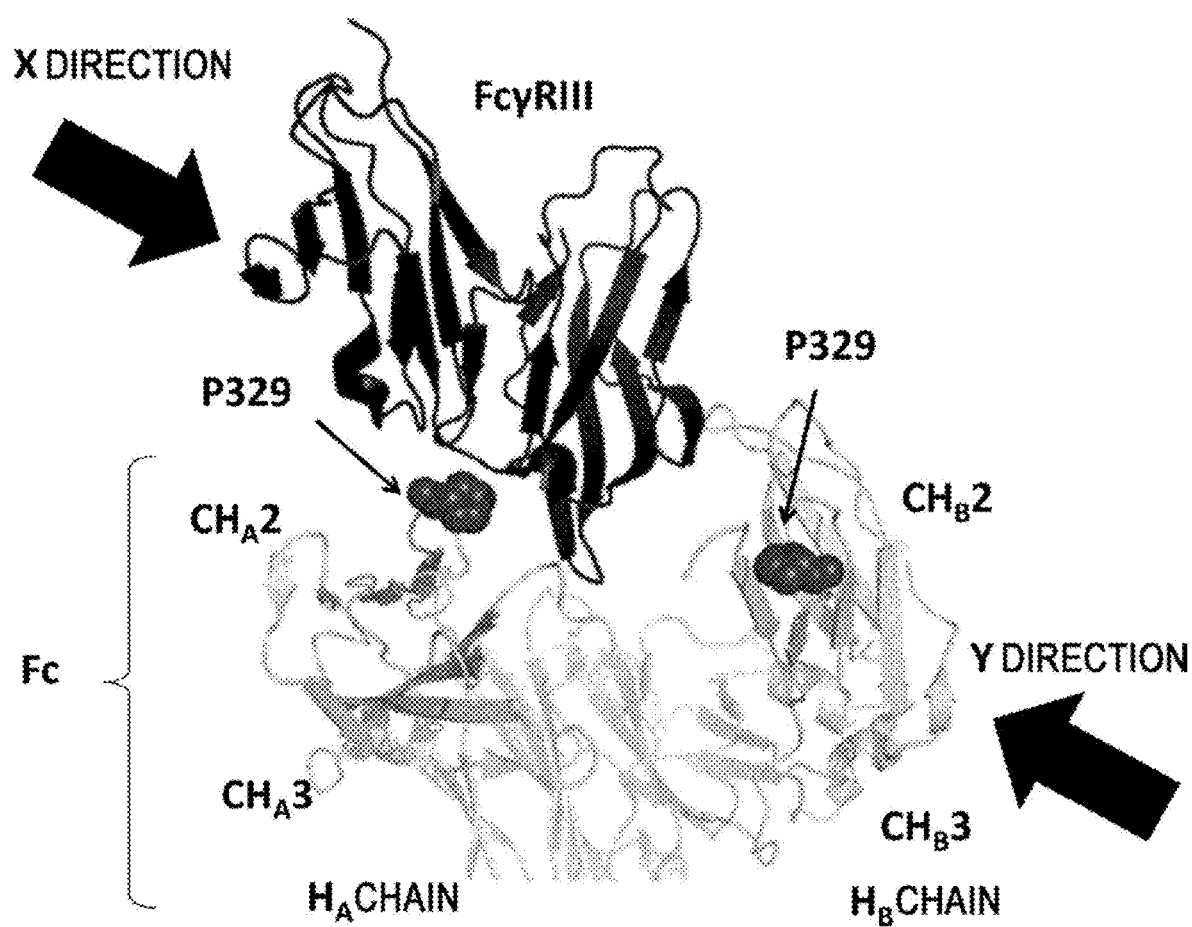

FIG. 12 shows interactions of P329 in the Fc region with FcγRIII. For the H chain, CH2, and CH3, those on the left side of the figure are referred to as the $H_A$ chain, $CH_A2$, and $CH_A3$, and those on the right side are referred to as the $H_B$ chain, $CH_B2$, and $CH_B3$, respectively. This figure shows that Pro at position 329 (EU numbering) in the Fc region interacts with FcγRIII mainly through $CH_A2$ which is a CH2 domain. For the H chain, CH2, and CH3, those on the left side of the figure are referred to as the $H_A$ chain, $CH_A2$, and $CH_A3$, and those on the right side are referred to as the $H_B$ chain, $CH_B2$, and $CH_B3$, respectively.

Figure 13:
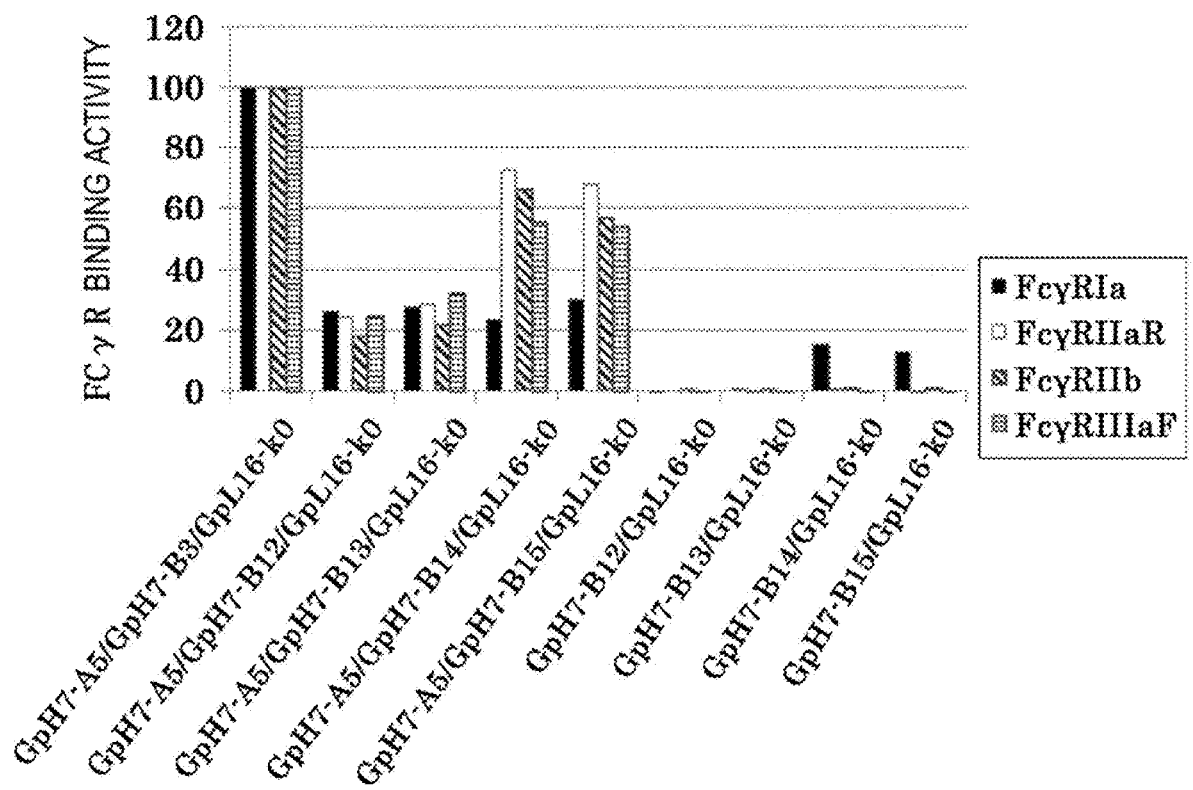

FIG. 13 shows comparison of the effects on FcγR-binding activities of homodimerized antibodies and heterodimerized antibodies into which P329R, P329K, P329D, or P329E has been introduced. The binding activity of GpH7-A5/GpH7-B3/GpL16-k0 (SEQ ID NOs: 3, 4, and 5) to each FcγR was defined as 100. The samples used for the evaluation and their sequences were GpH7-A5/GpH7-B3/GpL16-k0 (SEQ ID NOs: 3, 4, and 5), GpH7-A5/GpH7-B12/GpL16-k0 (SEQ ID NOs: 3, 12, and 5), GpH7-A5/GpH7-B13/GpL16-k0 (SEQ ID NOs: 3, 13, and 5), GpH7-A5/GpH7-B14/GpL16-k0 (SEQ ID NOs: 3, 14, and 5), GpH7-A5/GpH7-B15/GpL16-k0 (SEQ ID NOs: 3, 15, and 5), GpH7-B12/GpL16-k0 (SEQ ID NOs: 12 and 5), GpH7-B13/GpL16-k0 (SEQ ID NOs: 13 and 5), GpH7-B14/GpL16-k0 (SEQ ID NOs: 14 and 5), and GpH7-B15/GpL16-k0 (SEQ ID NOs: 15 and 5).

Figure 14:
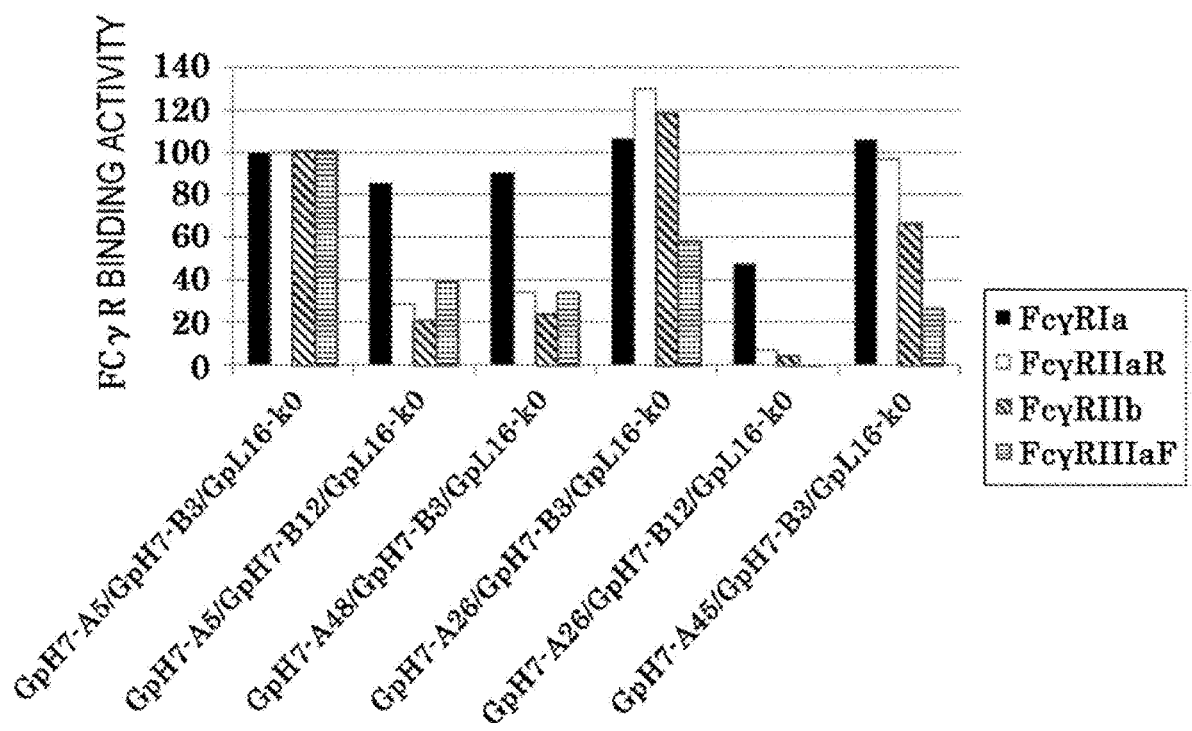

FIG. 14 shows comparison of binding activities to each FcγR of a heterodimerized antibody with G237A introduced into one of the H chains, when P329R is introduced into the same H chain or into the other H chain. The binding activity of GpH7-A5/GpH7-B3/GpL16-k0 (SEQ ID NOs: 3, 4, and 5) to each FcγR was defined as 100. The samples used for the evaluation and their sequences were GpH7-A5/GpH7-B3/GpL16-k0 (SEQ ID NOs: 3, 4, and 5), GpH7-A5/GpH7-B12/GpL16-k0 (SEQ ID NOs: 3, 12, and 5), GpH7-A48/ GpH7-B3/GpL16-k0 (SEQ ID NOs: 16, 4, and 5), GpH7-A26/GpH7-B3/GpL16-k0 (SEQ ID NOs: 6, 4, and 5), GpH7-A26/GpH7-B12/GpL16-k0 (SEQ ID NOs: 6, 12, and 5), and GpH7-A45/GpH7-B3/GpL16-k0 (SEQ ID NOs: 17, 4, and 5).

Figure 15:
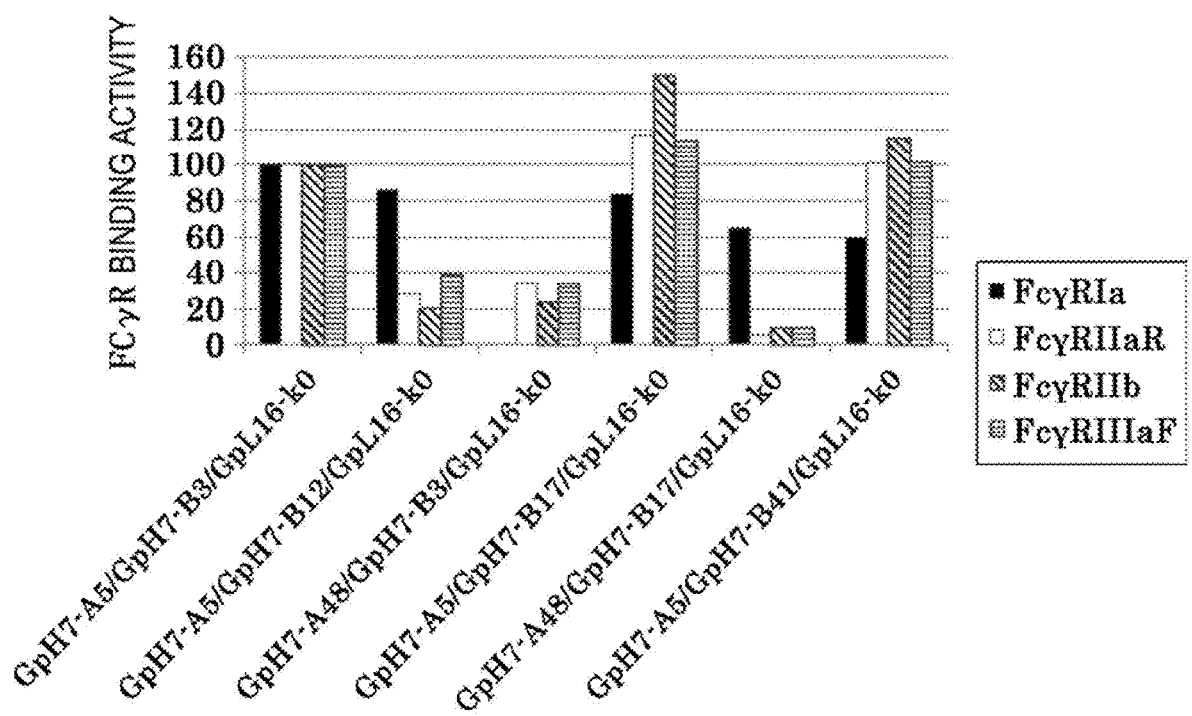

FIG. 15 shows comparison of binding activities to each FcγR of a heterodimerized antibody with L234D introduced into one of the H chains, when P329R is introduced into the same H chain or into the other H chain. The binding activity of GpH7-A5/GpH7-B3/GpL16-k0 (SEQ ID NOs: 3, 4, and 5) to each FcγR was defined as 100. The samples used for the evaluation and their sequences were GpH7-A5/GpH7-B3/GpL16-k0 (SEQ ID NOs: 3, 4, and 5), GpH7-A5/GpH7-B12/GpL16-k0 (SEQ ID NOs: 3, 12, and 5), GpH7-A48/ GpH7-B3/GpL16-k0 (SEQ ID NOs: 16, 4, and 5), GpH7-A5/GpH7-B17/GpL16-k0 (SEQ ID NOs: 3, 11, and 5), GpH7-A48/GpH7-B17/GpL16-k0 (SEQ ID NOs: 16, 11, and 5), and GpH7-A5/GpH7-B41/GpL16-k0 (SEQ ID NOs: 3, 18, and 5).

Figure 16:
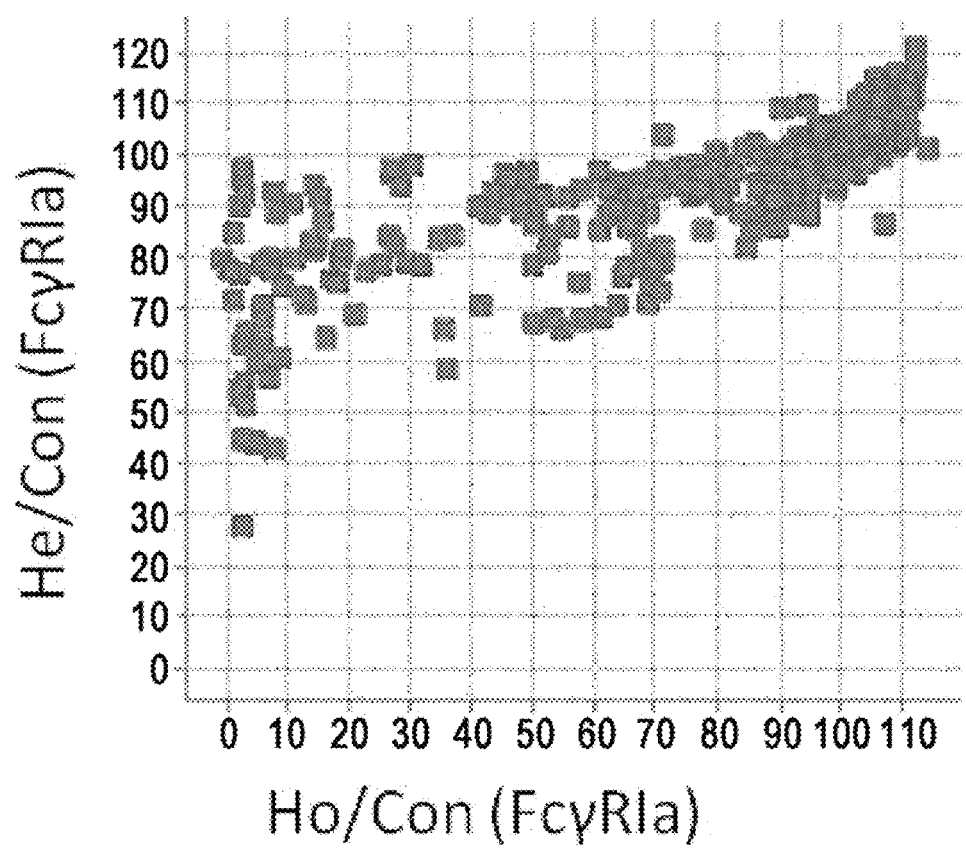

FIG. 16 shows comparison of FcγRIa-binding activities of homodimerized antibodies and heterodimerized antibodies into which identical alterations have been introduced. The horizontal axis shows the Ho/Con values, and the vertical axis shows the He/Co values. He/Con is a value obtained by dividing the FcγRIa-binding activity of the heterodimerized antibody GpH7-A5/GpH7-B3 variant/GpL16-k0, which uses a mutated GpH7-B3 variant for one of the H chains, by the FcγRIa-binding activity of the heterodimerized antibody GpH7-A5/GpH7-B3/GpL16-k0 (SEQ ID NOs: 3, 4, and 5), which uses the unmutated GpH7-B3, and multiplying the result by 100. Ho/Con is a value obtained by dividing the FcγRIa-binding activity of the homodimerized antibody GpH7-B3 variant/GpL16-k0, which uses a mutated GpH7-B3 variant for both H chains, by the FcγRIa-binding activity of the homodimerized antibody GpH7-B3/GpL16-k0 (SEQ ID NOs: 4 and 5), which uses the unmutated GpH7-B3, and multiplying the result by 100.

Figure 17:
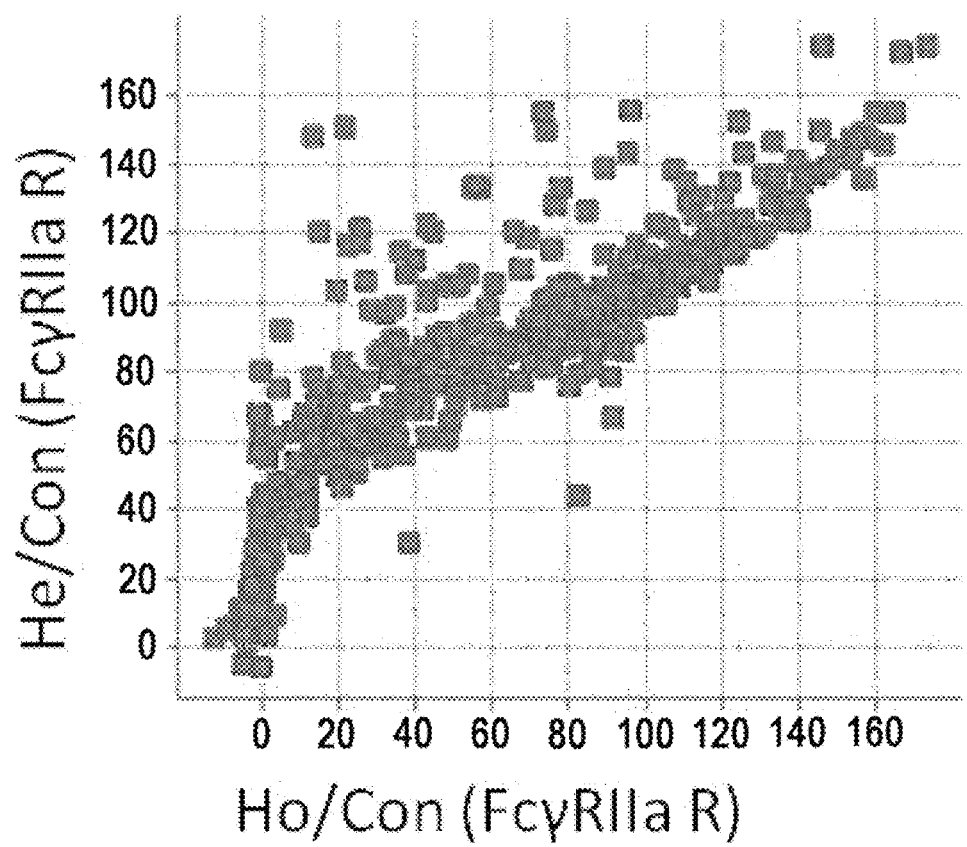

FIG. 17 shows comparison of FcγRIIa R-binding activities of homodimerized antibodies and heterodimerized antibodies into which identical alterations have been introduced. The horizontal axis shows the Ho/Con values, and the vertical axis shows the He/Co values. He/Con is a value obtained by dividing the FcγRIIa R-binding activity of the heterodimerized antibody GpH7-A5/GpH7-B3 variant/GpL16-k0, which uses a mutated GpH7-B3 variant for one of the H chains, by the FcγRIIa R-binding activity of the heterodimerized antibody GpH7-A5/GpH7-B3/GpL16-k0 (SEQ ID NOs: 3, 4, and 5), which uses the unmutated GpH7-B3. Ho/Con is a value obtained by dividing the FcγRIIa R-binding activity of the homodimerized antibody GpH7-B3 variant/GpL16-k0, which uses a mutated GpH7-B3 variant for both H chains, by the FcγRIIa R-binding activity of the homodimerized antibody GpH7-B3/GpL16-k0 (SEQ ID NOs: 4 and 5), which uses the unmutated GpH7-B3, and multiplying the result by 100.

Figure 18:
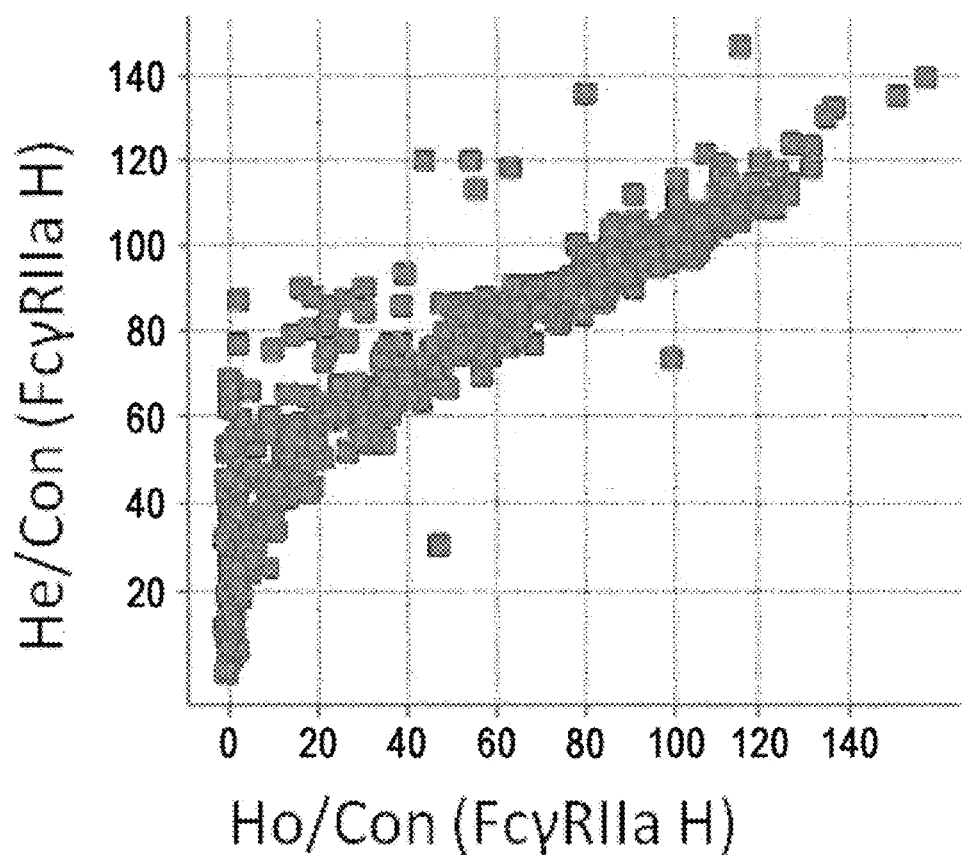

FIG. 18 shows comparison of FcγRIIa H-binding activities of homodimerized antibodies and heterodimerized antibodies into which identical alterations have been introduced. The horizontal axis shows the Ho/Con values, and the vertical axis shows the He/Co values. He/Con is a value obtained by dividing the FcγRIIa H-binding activity of the heterodimerized antibody GpH7-A5/GpH7-B3 variant/GpL16-k0, which uses a mutated GpH7-B3 variant for one of the H chains, by the FcγRIIa H-binding activity of the heterodimerized antibody GpH7-A5/GpH7-B3/GpL16-k0 (SEQ ID NOs: 3, 4, and 5), which uses the unmutated GpH7-B3. Ho/Con is a value obtained by dividing the FcγRIIa H-binding activity of the homodimerized antibody GpH7-B3 variant/GpL16-k0, which uses a mutated GpH7-B3 variant for both H chains, by the FcγRIIa H-binding activity of the homodimerized antibody GpH7-B3/GpL16-k0 (SEQ ID NOs: 4 and 5), which uses the unmutated GpH7-B3, and multiplying the result by 100.

Figure 19:
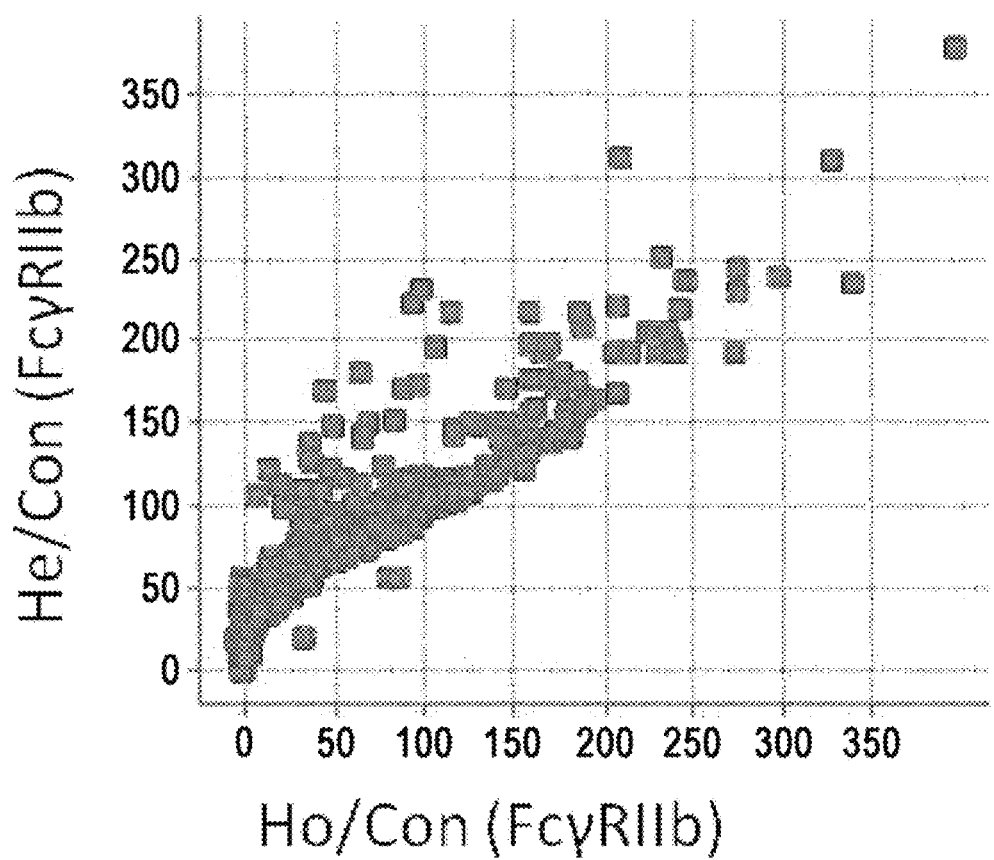

FIG. 19 shows comparison of FcγRIIb-binding activities of homodimerized antibodies and heterodimerized antibodies into which identical alterations have been introduced. The horizontal axis shows the Ho/Con values, and the vertical axis shows the He/Co values. He/Con is a value obtained by dividing the FcγRIIb-binding activity of the heterodimerized antibody GpH7-A5/GpH7-B3 variant/GpL16-k0, which uses a mutated GpH7-B3 variant for one of the H chains, by the FcγRIIb-binding activity of the heterodimerized antibody GpH7-A5/GpH7-B3/GpL16-k0 (SEQ ID NOs: 3, 4, and 5), which uses the unmutated GpH7-B3. Ho/Con is a value obtained by dividing the FcγRIIb-binding activity of the homodimerized antibody GpH7-B3 variant/GpL16-k0, which uses a mutated GpH7-B3 variant for both H chains, by the FcγRIIb-binding activity of the homodimerized antibody GpH7-B3/GpL16-k0 (SEQ ID NOs: 4 and 5), which uses the unmutated GpH7-B3, and multiplying the result by 100.

Figure 20:
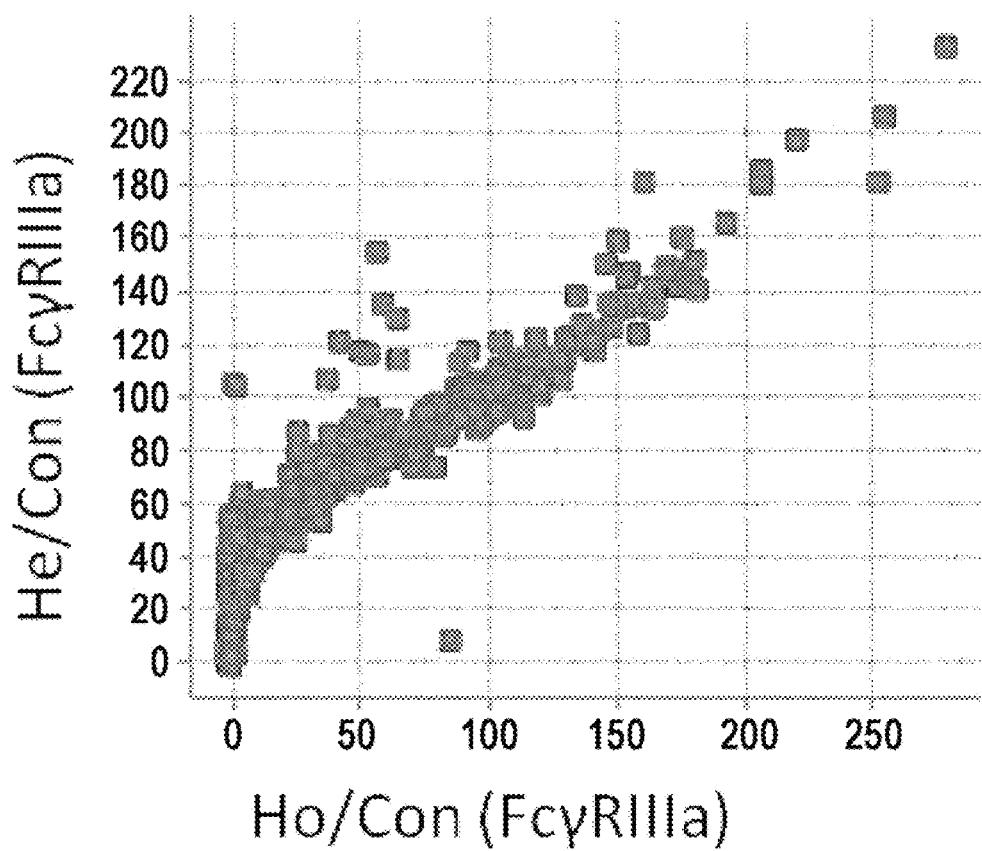

FIG. 20 shows comparison of FcγRIIIa-binding activities of homodimerized antibodies and heterodimerized antibodies into which identical alterations have been introduced. The horizontal axis shows the Ho/Con values, and the vertical axis shows the He/Co values. He/Con is a value obtained by dividing the FcγRIIIa-binding activity of the heterodimerized antibody GpH7-A5/GpH7-B3 variant/GpL16-k0, which uses a mutated GpH7-B3 variant for one of the H chains, by the FcγRIIIa-binding activity of the heterodimerized antibody GpH7-A5/GpH7-B3/GpL16-k0 (SEQ ID NOs: 3, 4, and 5), which uses the unmutated GpH7-B3. Ho/Con is a value obtained by dividing the FcγRIIIa binding activity of the homodimerized antibody GpH7-B3 variant/GpL16-k0, which uses a mutated GpH7-B3 variant for both H chains, by the FcγRIIIa-binding activity to of the homodimerized antibody GpH7-B3/GpL16-k0 (SEQ ID NOs: 4 and 5), which uses the unmutated GpH7-B3, and multiplying the result by 100.

Figure 21:
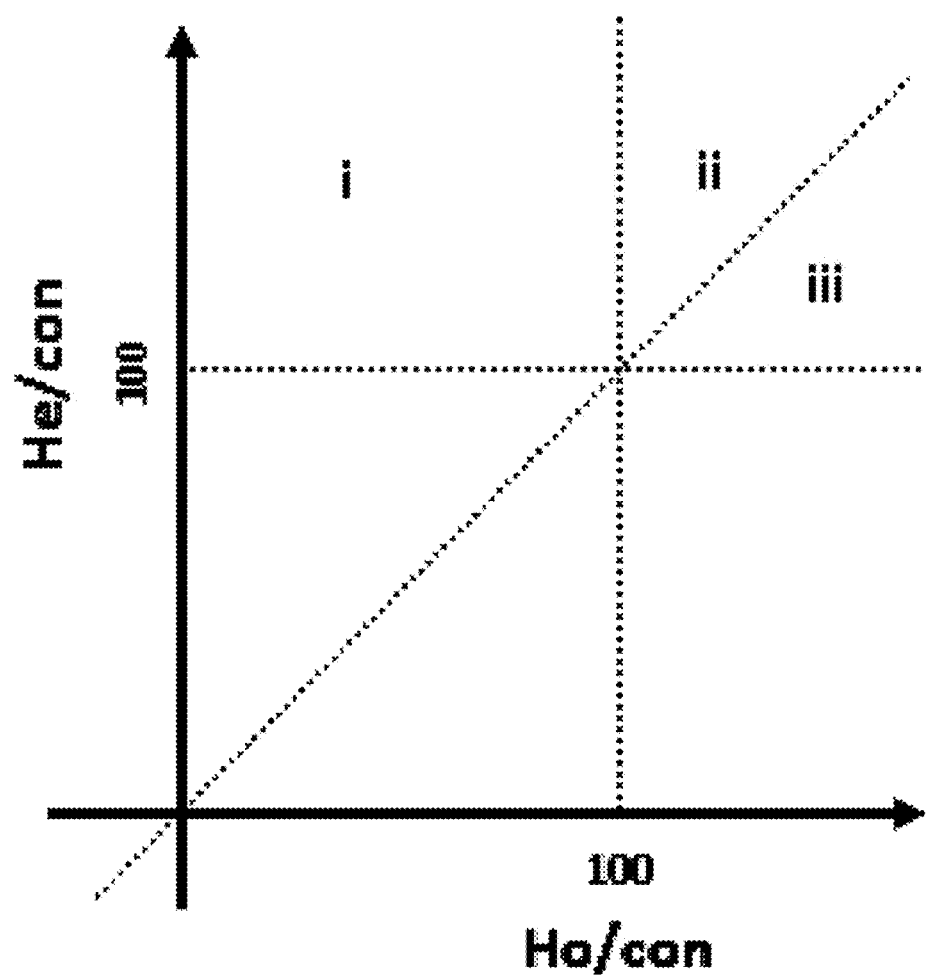

FIG. 21 shows a conceptual diagram comparing FcγR-binding of each of the homodimerized antibodies and heterodimerized antibodies which use H chains into which alterations have been introduced. When a plotted point is contained within Region i, it means that the alteration introduced into the Fc region has the effect of yielding He/Con>100, Ho/Con<100, He/Con>Ho/Con. When a plotted point is contained within Region ii, it means that the alteration introduced into the Fc region has the effect of yielding He/Con>100, Ho/Con>100, He/Con>Ho/Con. When a plotted point is contained within Region iii, it means that the alteration introduced into the Fc region has the effect of yielding He/Con>100, Ho/Con>100, He/Con<Ho/Con.

Figure 22:
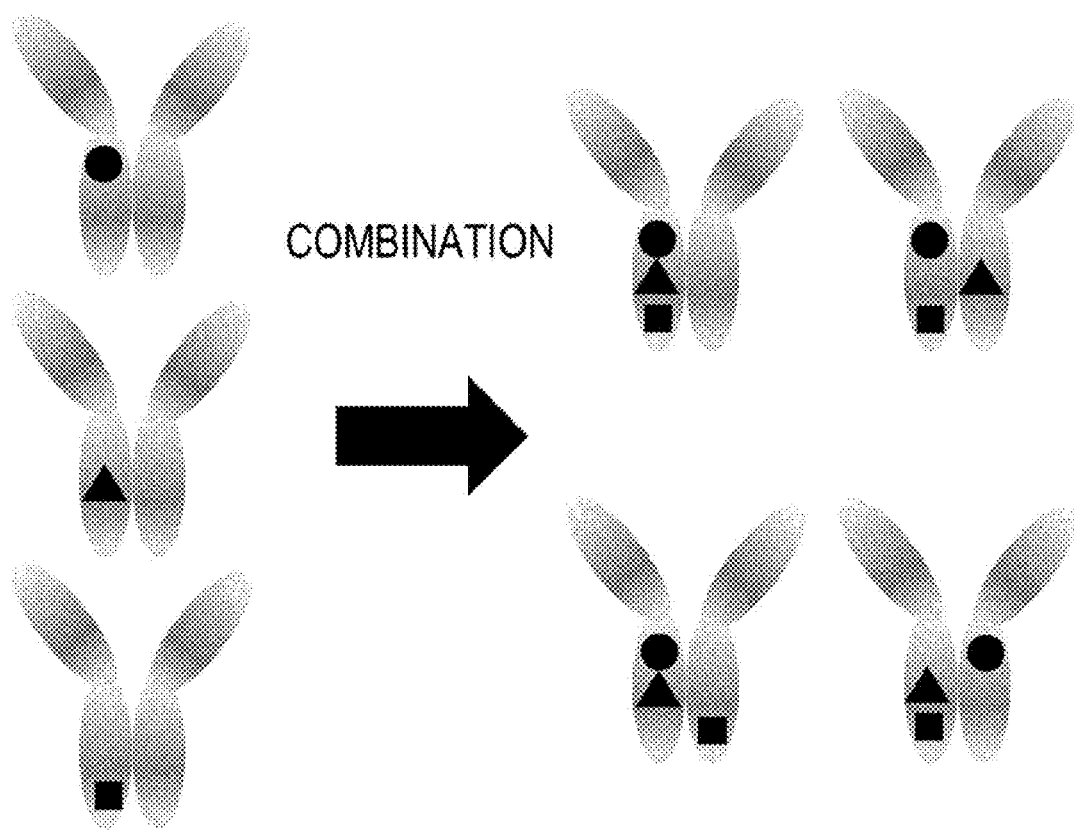

FIG. 22 shows the number of combinations produced when three types of alterations are introduced into any of the H chains of a heterodimerized antibody. Each of the filled circles (●), filled triangle (▲), and filled square (■) refers to a different alteration.

Figure 23:
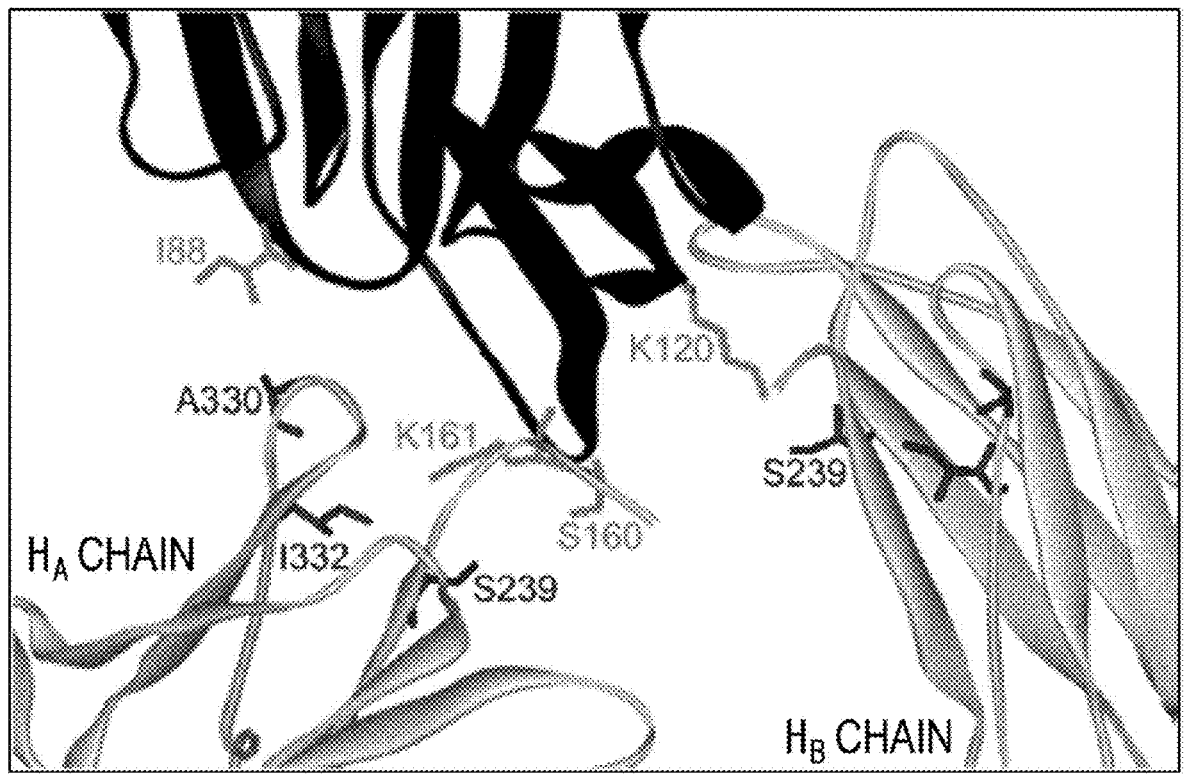

FIG. 23 shows the interaction between FcγRIII and each of the residues S239, A330, and I332 in the antibody Fc region. Cited from Proc. Natl. Acad. Sci. USA, 103, 4005-4010, 2006.

Figure 24:
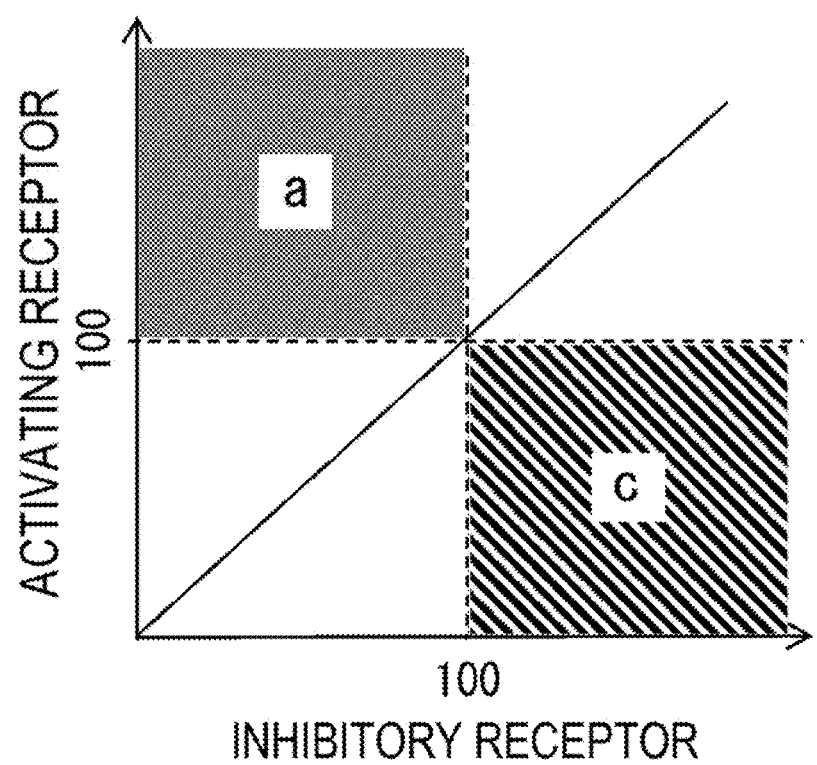

FIG. 24 shows comparison of binding activities to activating FcγR and inhibitory FcγR. It is a conceptual diagram comparing the binding activities of each variant to activating FcγR and inhibitory FcγR. The vertical axis shows the activity of each variant towards activating FcγR (Activating Receptor), and the horizontal axis shows the binding activity of each variant to inhibitory FcγR (Inhibitory Receptor). The binding activities of the naturally-occurring antibody to activating FcγR and inhibitory FcγR were each set to 100. When a variant has enhanced binding activity to activating FcγR over the naturally-occurring antibody and decreased binding activity to inhibitory FcγR, the antibody is plotted in Region a (shadow area). When a variant has enhanced binding activity to inhibitory FcγR over the naturally-occurring antibody, and decreased binding activity to activating FcγR, the antibody is plotted in Region c (shaded area).

Figure 25:
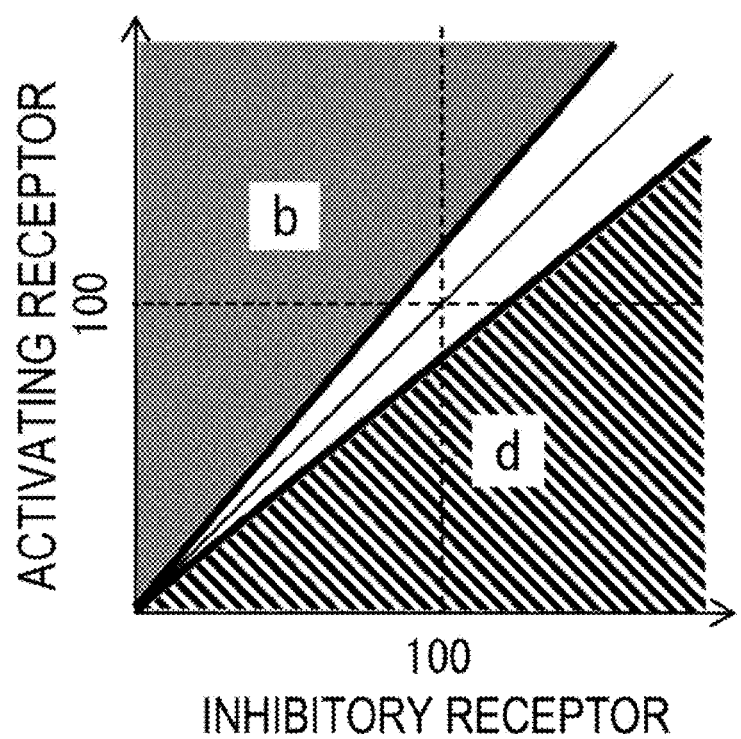

FIG. 25 shows comparison of binding activities to activating FcγR and inhibitory FcγR. It is a conceptual diagram comparing the binding activities of each variant to activating FcγR and inhibitory FcγR. The vertical axis shows the binding activity of a naturally-occurring antibody to activating FcγR (Activating Receptor), and the horizontal axis shows the binding activity to inhibitory FcγR (Inhibitory Receptor). The binding activities of the naturally-occurring antibody to activating FcγR and inhibitory FcγR were each set to 100. When the value obtained by dividing the binding activity of a variant to activating FcγR by the binding activity to inhibitory FcγR is 1.2 or greater, the antibody is plotted in Region b (shadow area). When the value obtained by dividing the binding activity of a variant to activating FcγR by the binding activity to inhibitory FcγR is 0.8 or lower, the antibody is plotted in Region d (shaded area).

Figure 26:
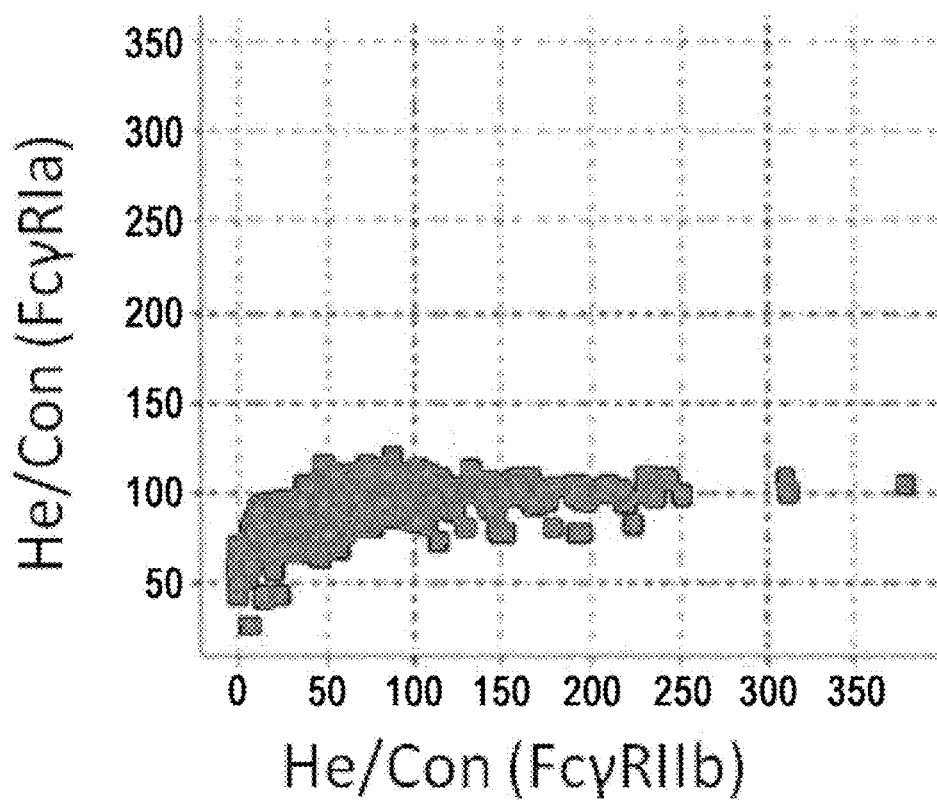

FIG. 26 shows comparison of binding activities of a heterodimerized antibody to FcγRIa and FcγRIIb. It is a diagram that compares the binding activities of an altered heterodimerized antibody to FcγRIa which is an activating FcγR and to FcγRIIb which is an inhibitory FcγR. The horizontal axis shows the values of Ho/Con for inhibitory FcγR, and the vertical axis shows the values for He/Con for activating FcγR. He/Con is a value obtained by dividing the FcγR-binding activity of the heterodimerized antibody GpH7-A5/GpH7-B3 variant/GpL16-k0 which has a mutated Fc, by the FcγR-binding activity of the heterodimerized antibody GpH7-A5/GpH7-B3/GpL16-k0 (SEQ ID NOs: 3, 4, and 5) which has no introduction of alterations, and multiplying the result by 100.

Figure 27:
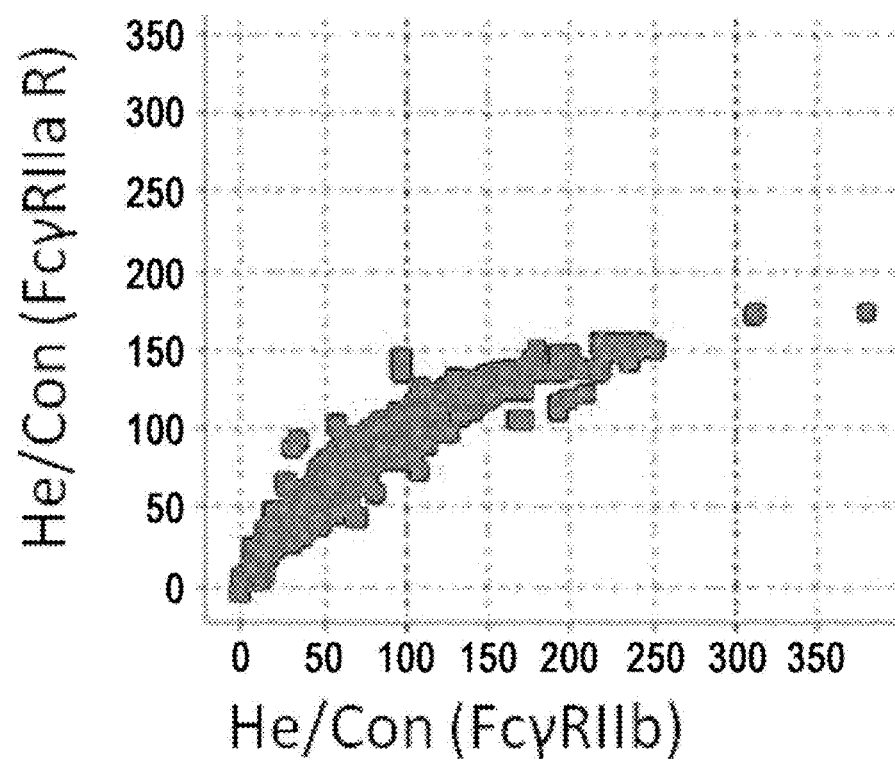

FIG. 27 shows comparison of binding activities of a heterodimerized antibody to FcγRIIa R and FcγRIIb. It is a diagram that compares the binding activities of an altered heterodimerized antibody to FcγRIIa R which is an activating FcγR and to FcγRIIb which is an inhibitory FcγR. The horizontal axis shows the values of He/Con for inhibitory FcγR, and the vertical axis shows the values for He/Con for activating FcγR. He/Con is a value obtained by dividing the FcγR-binding activity of the heterodimerized antibody GpH7-A5/GpH7-B3 variant/GpL16-k0, which has a mutated Fc, by the FcγR-binding activity of the heterodimerized antibody GpH7-A5/GpH7-B3/GpL16-k0 (SEQ ID NOs: 3, 4, and 5) which has no introduction of alterations, and multiplying the result by 100.

Figure 28:
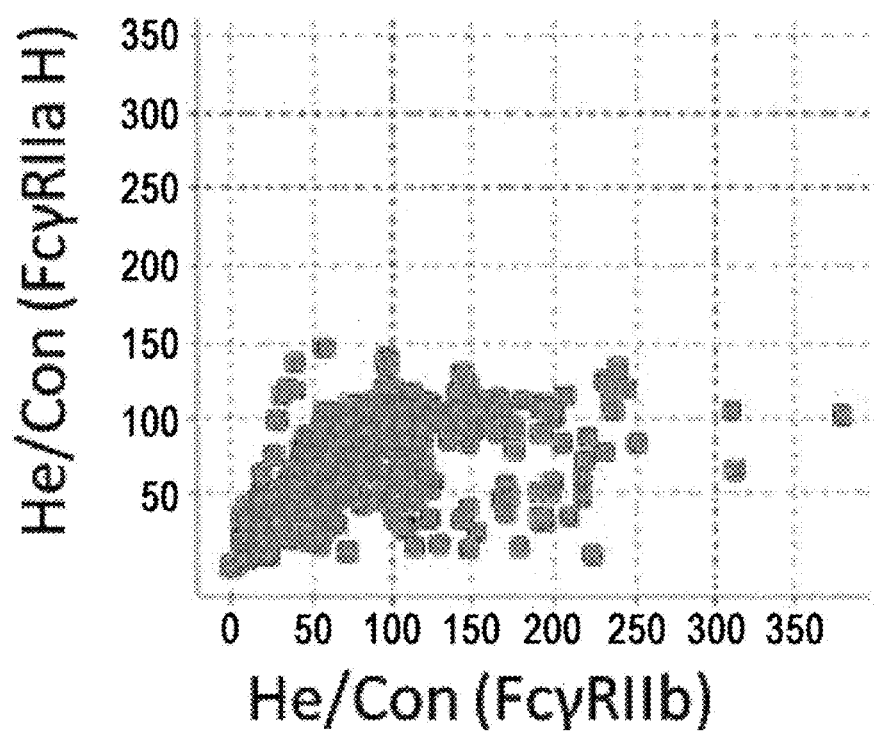

FIG. 28 shows comparison of binding activities of a heterodimerized antibody to FcγRIIa H and FcγRIIb. It is a diagram that compares the binding activities of an altered heterodimerized antibody to FcγRIIa H which is an activating FcγR, and to FcγRIIb which is an inhibitory FcγR. The horizontal axis shows the values of He/Con for inhibitory FcγR, and the vertical axis shows the values for He/Con for activating FcγR. He/Con is a value obtained by dividing the FcγR-binding activity of the heterodimerized antibody GpH7-A5/GpH7-B3 variant/GpL16-k0, which has a mutated Fc, by the FcγR-binding activity of the heterodimerized antibody GpH7-A5/GpH7-B3/GpL16-k0 (SEQ ID NOs: 3, 4, and 5) which has no introduction of alterations, and multiplying the result by 100.

Figure 29:
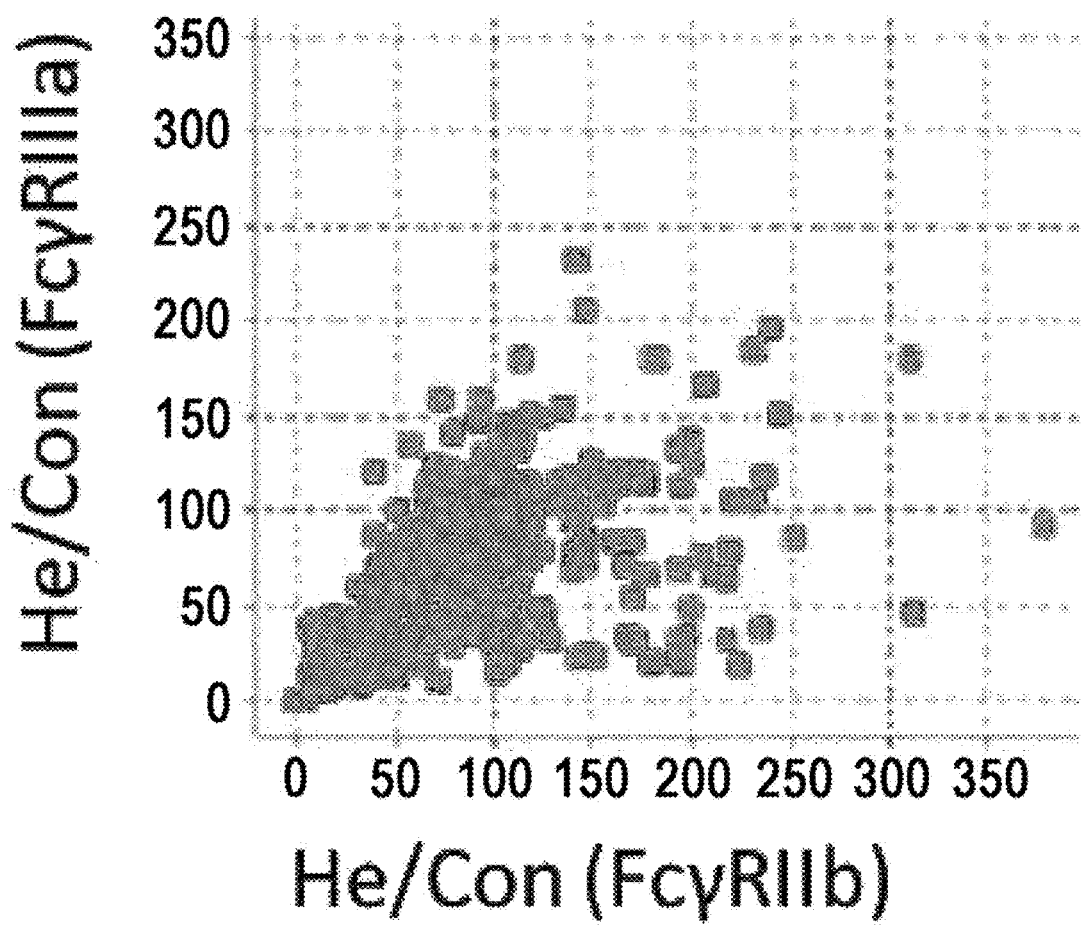

FIG. 29 shows comparison of binding activities of a heterodimerized antibody to FcγRIIIa and FcγRIIb. It is a diagram that compares the binding activities of an altered heterodimerized antibody to FcγRIIIa which is an activating FcγR and to FcγRIIb which is an inhibitory FcγR. The horizontal axis shows the values of He/Con for inhibitory FcγR, and the vertical axis shows the values of He/Con for activating FcγR. He/Con is a value obtained by dividing the FcγR-binding activity of the heterodimerized antibody GpH7-A5/GpH7-B3 variant/GpL16-k0 which has a mutated Fc, by the FcγR-binding activity of the heterodimerized antibody GpH7-A5/GpH7-B3/GpL16-k0 (SEQ ID NOs: 3, 4, and 5) which has no introduction of alterations, and multiplying the result by 100.

Figure 30:
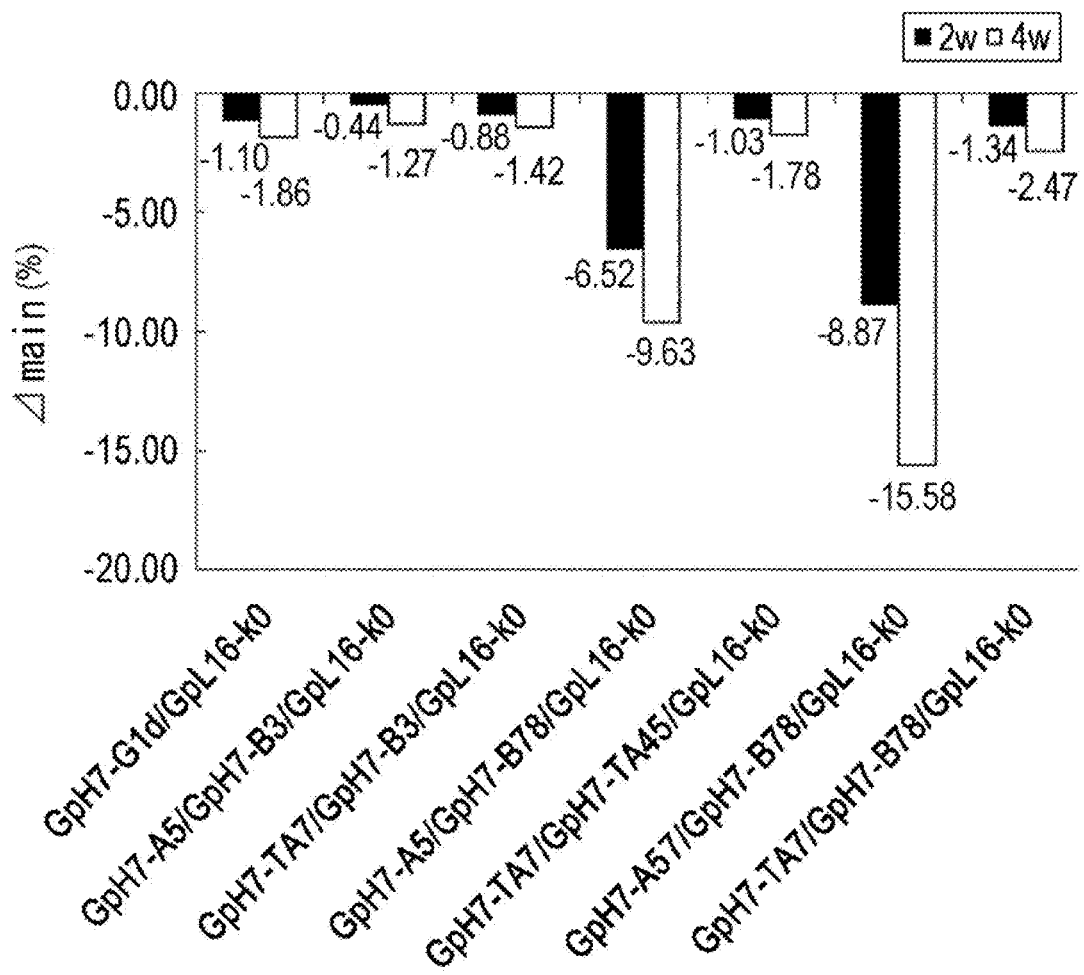

FIG. 30 shows comparison of the effects of combinations of L234Y, G236W and S298A, with S239D, A330L and I332E on the thermal stability of antibodies. It is a graph that compares the changes in monomer content after a heat accelerated stability study (40° C. for two weeks or four weeks) was performed for homodimerized antibodies and heterodimerized antibodies with L234Y, G236W and S298A, homodimerized antibodies and heterodimerized antibodies with S239D, A330L, and I332E, and heterodimerized antibodies in which L234Y, G236W and S298A are introduced into one of the H chains and S239D, A330L, and I332E are introduced into the other H chain. The samples used for the evaluation and their sequences were GpH7-G1d/GpL16-k0 (SEQ ID NOs: 2 and 5), GpH7-A5/GpH7-B3/GpL16-k0 (SEQ ID NOs: 3, 4, and 5), GpH7-TA7/GpH7-B3/GpL16-k0 (SEQ ID NOs: 31, 4, and 5), GpH7-A5/GpH7-B78/GpL16-k0 (SEQ ID NO: 3, 41, and 5), GpH7-TA7/GpH7-TA45/GpL16-k0 (SEQ ID NOs: 31, 32, and 5), GpH7-A57/GpH7-B78/GpL16-k0 (SEQ ID NO: 40, 41, and 5), and GpH7-TA7/GpH7-B78/GpL16-k0 (SEQ ID NO: 31, 41, and 5).

Figure 31:
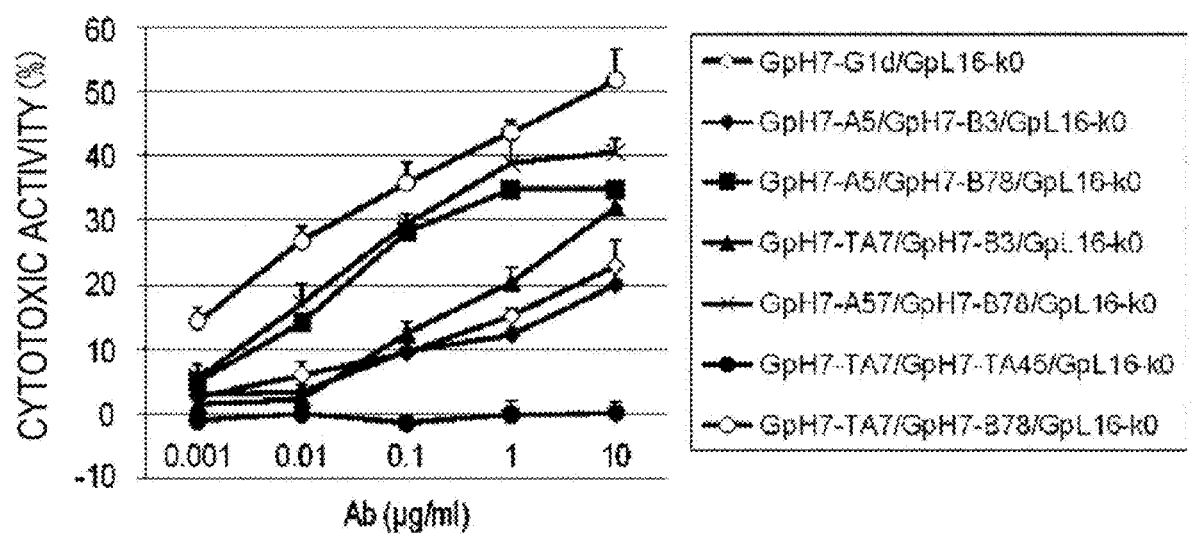

FIG. 31 shows a result of examining the ADCC activities of heterodimerized antibodies. The cell line used for the evaluation was SK-pca13a, and the E/T ratio was 50. Human PBMCs were used as the effector cell. The samples used for the evaluation and their sequences were GpH7-G1d/GpL16-k0 (SEQ ID NOs: 2 and 5), GpH7-A5/GpH7-B3/GpL16-k0 (SEQ ID NOs: 3, 4, and 5), GpH7-A5/GpH7-B78/GpL16-k0 (SEQ ID NO: 3, 41, and 5), GpH7-TA7/GpH7-B3/GpL16-k0 (SEQ ID NOs: 31, 4, and 5), GpH7-A57/GpH7-B78/GpL16-k0 (SEQ ID NO: 40, 41, and 5), GpH7-TA7/GpH7-TA45/GpL16-k0 (SEQ ID NOs: 31, 32, and 5), and GpH7-TA7/GpH7-B78/GpL16-k0 (SEQ ID NOs: 31, 41, and 5). The vertical axis shows the antibody cytotoxic activity, and the horizontal axis shows the antibody concentration (μg/mL).

Figure 32:
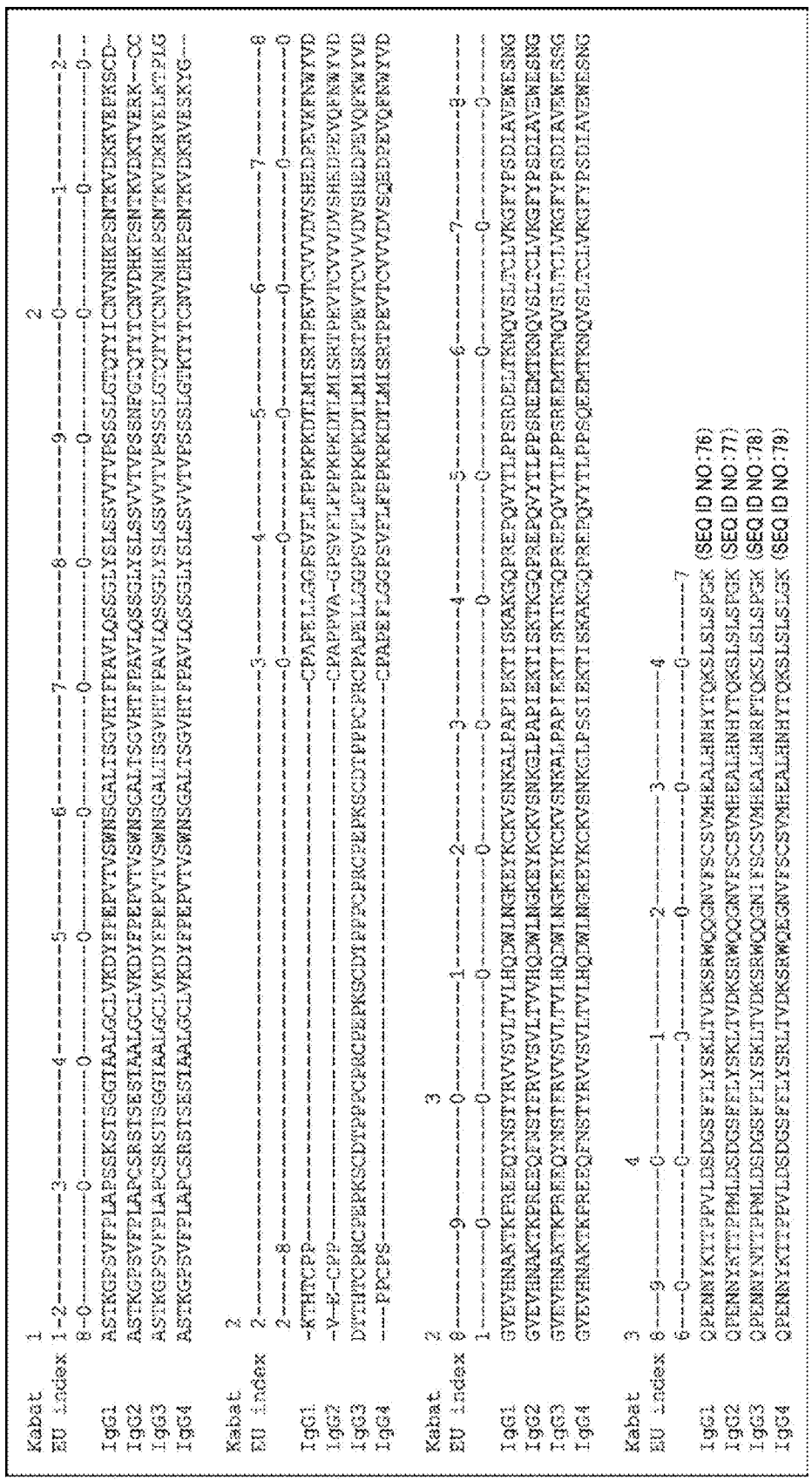

FIG. 32 shows the amino acid residues constituting the Fc regions of IgG1 (SEQ ID NO: 76), IgG2 (SEQ ID NO: 77), IgG3 (SEQ ID NO: 78), and IgG4 (SEQ ID NO: 79), and their relation to Kabat's EU numbering (herein, also referred to as EU INDEX).

Figure 33:
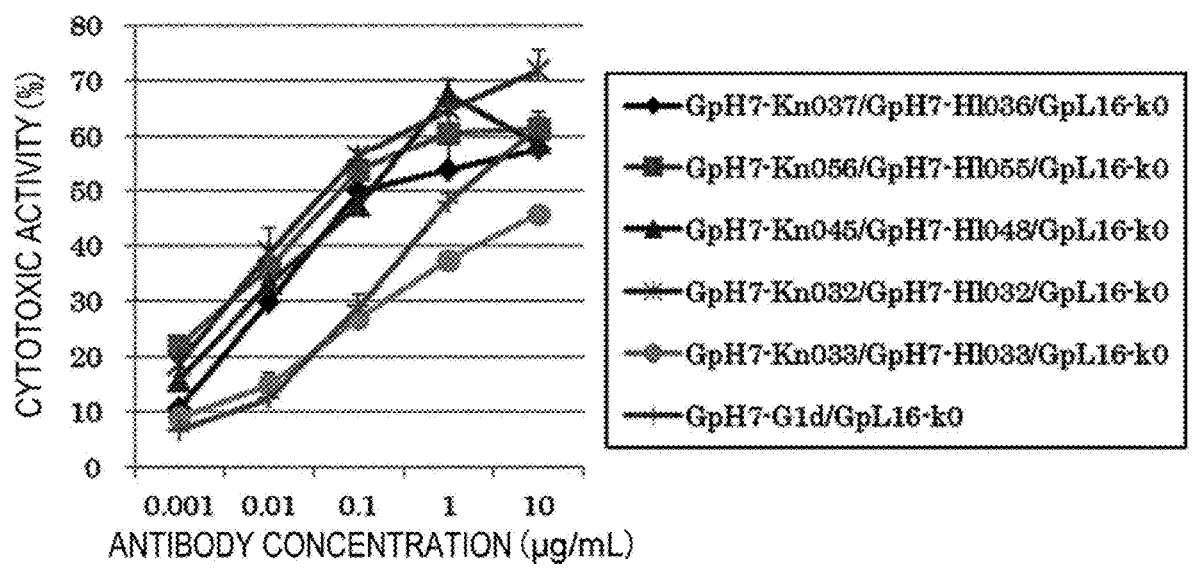

FIG. 33 shows a result of examining the ADCC activities of the Fc heterodimerized antibodies described in Example 12. The cell line used for the evaluation was SK-pca13a, and the E/T ratio was 50. Human PBMCs were used as the effector cell. The samples used for the evaluation and their sequences were GpH7-G1d/GpL16-k0 (SEQ ID NOs: 2 and 5), GpH7-Kn033/GpH7-HI033/GpL16-k0 (SEQ ID NOs: 51, 56, and 5), GpH7-Kn032/GpH7-HI032/GpL16-k0 (SEQ ID NOs: 53, 58, and 5), GpH7-Kn045/GpH7-HI048/GpL16-k0 (SEQ ID NOs: 54, 59, and 5), GpH7-Kn056/GpH7-HI055/GpL16-k0 (SEQ ID NOs: 55, 60, and 5), and GpH7-Kn037/GpH7-HI036/GpL16-k0 (SEQ ID NOs: 52, 57, and 5). The vertical axis shows the antibody cytotoxic activity, and the horizontal axis shows the antibody concentration Gig/nap.

Figure 34:
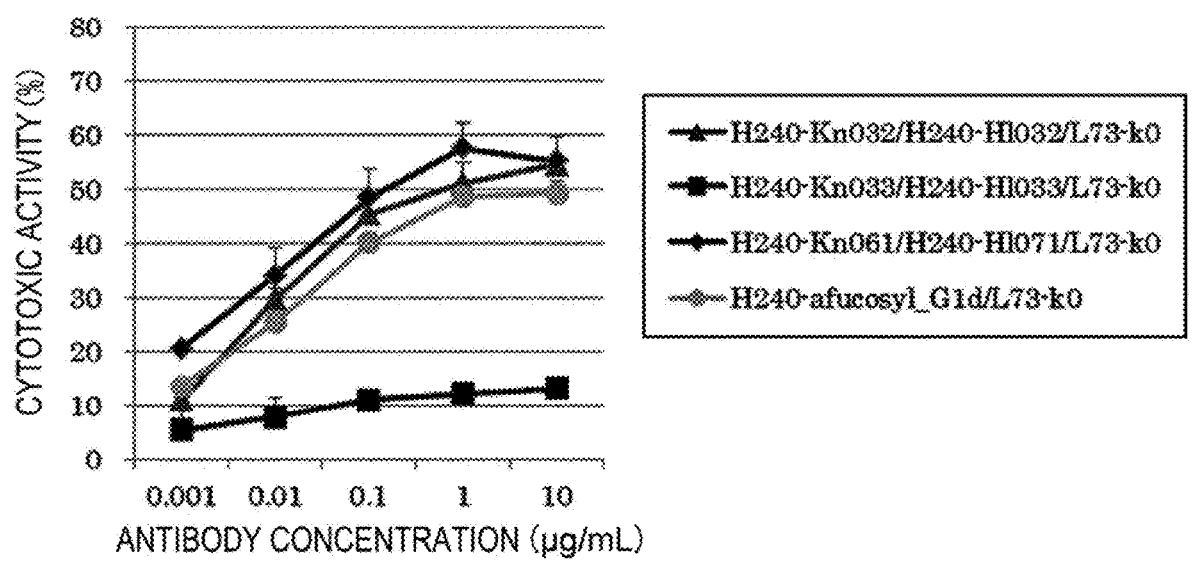

FIG. 34 shows a result of examining the ADCC activity of the heterodimerized antibody H240-Kn061/H240-Hl071/L73-k0. The cell line used for the evaluation was SKE18, and the E/T ratio was 50. Human PBMCs were used as the effector cell. The samples used for the evaluation and their sequences were H240-Kn033/H240-Hl033/L73-k0 (SEQ ID NOs: 84, 85, and 106), H240-Kn032/H240-Hl032/L73-k0 (SEQ ID NOs: 86, 87, and 106), H240-Kn061/H240-Hl071/L73-k0 (SEQ ID NOs: 81, 82, and 106), and H240-afucosyl_G1d (the amino acid sequence of H240-afucosyl_G1d is the same as that of H240-G1d (SEQ ID NO: 83), but the fucose is removed)/L73-k0 (SEQ ID NOs: 83 and 106). The vertical axis shows the antibody cytotoxic activity, and the horizontal axis shows the antibody concentration (μg/mL).

Figure 35:
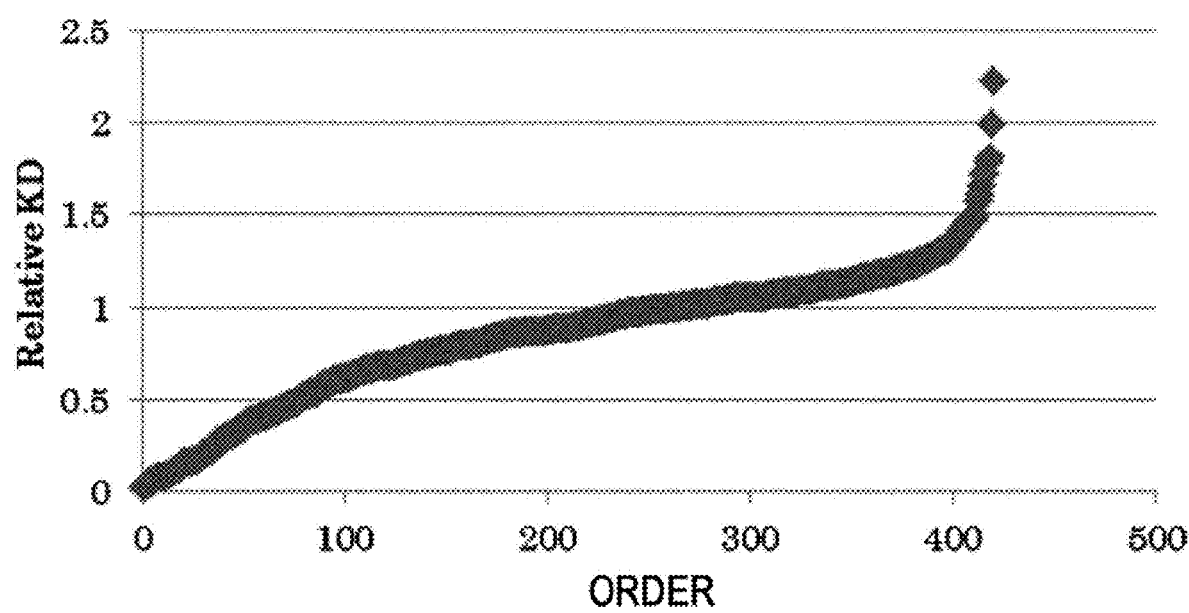

FIG. 35 shows the FcgRI-binding activity of a point mutant which uses the heterodimerized antibody H240-Kn061/H240-Hl071/L73-k0 as template. Relative KD on the vertical axis shows the value obtained by dividing the KD (mol/L) of H240-Kn061/H240-Hl071/L73-k0 to FcgRI by the KD of each variant. The numbers on the horizontal axis show the ranks when the Relative KDs are arranged in ascending order.

Figure 36:
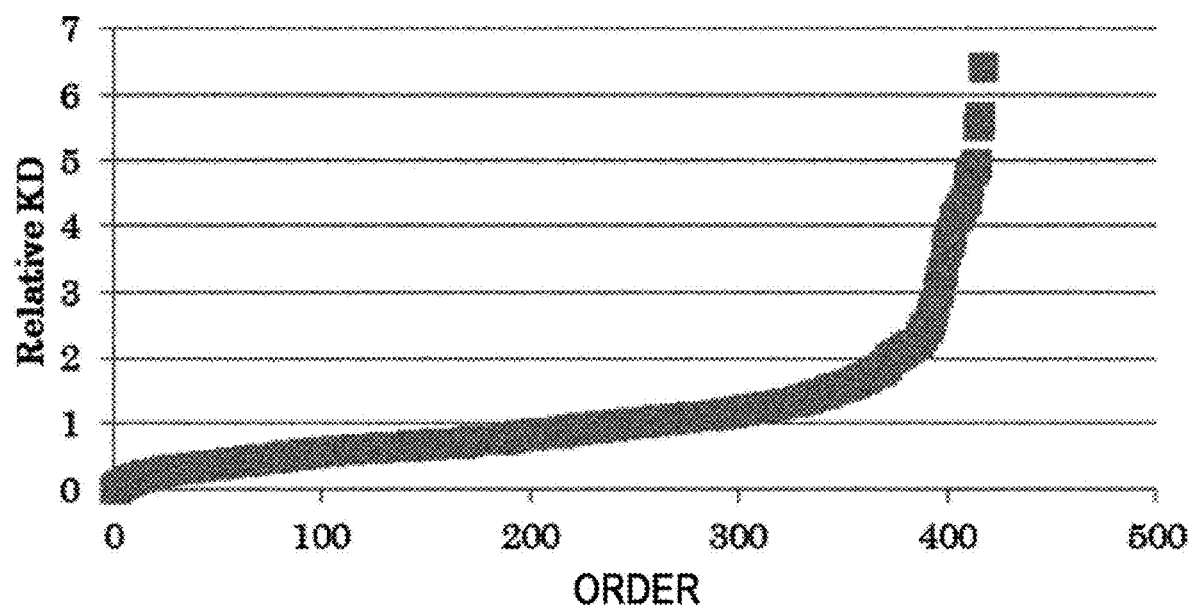

FIG. 36 shows the FcgRIIa R-binding activity of a point mutant which uses the heterodimerized antibody H240-Kn061/H240-Hl071/L73-k0 as template. Relative KD on the vertical axis shows the value obtained by dividing the KD (mol/L) of H240-Kn061/H240-Hl071/L73-k0 to FcgRIIa R by the KD of each variant. The numbers on the horizontal axis show the ranks when the Relative KDs are arranged in ascending order.

Figure 37:
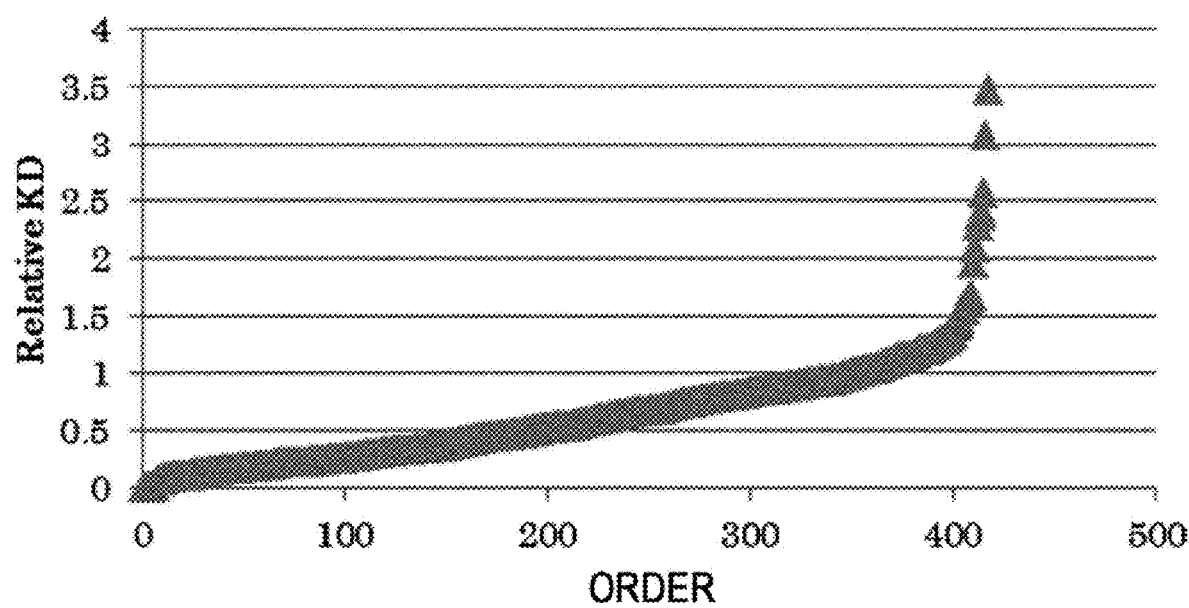

FIG. 37 shows the FcgRIIa H-binding activity of a point mutant which uses the heterodimerized antibody H240-Kn061/H240-Hl071/L73-k0 as template. Relative KD on the vertical axis shows the value obtained by dividing the KD (mol/L) of H240-Kn061/H240-Hl071/L73-k0 to FcgRIIa H by the KD of each variant. The numbers on the horizontal axis show the ranks when the Relative KDs are arranged in ascending order.

Figure 38:
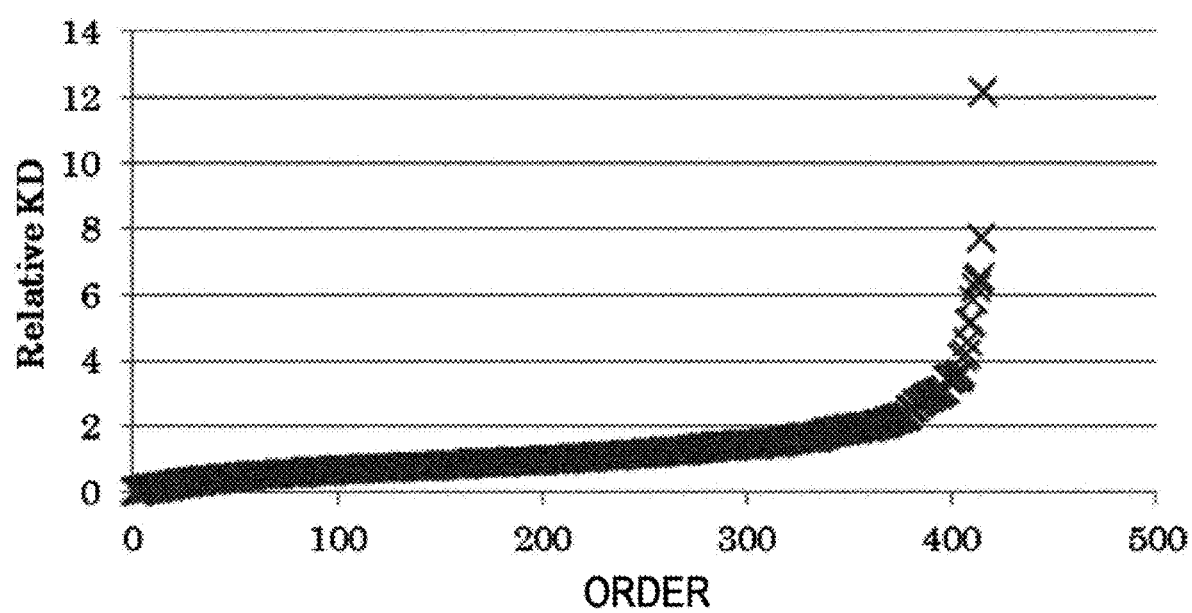

FIG. 38 shows the FcgRIIb-binding activity of a point mutant which uses the heterodimerized antibody H240-Kn061/H240-Hl071/L73-k0 as template. Relative KD on the vertical axis shows the value obtained by dividing the KD (mol/L) of H240-Kn061/H240-Hl071/L73-k0 to FcgRIIb by the KD of each variant. The numbers on the horizontal axis show the ranks when the Relative KDs are arranged in ascending order.

Figure 39:
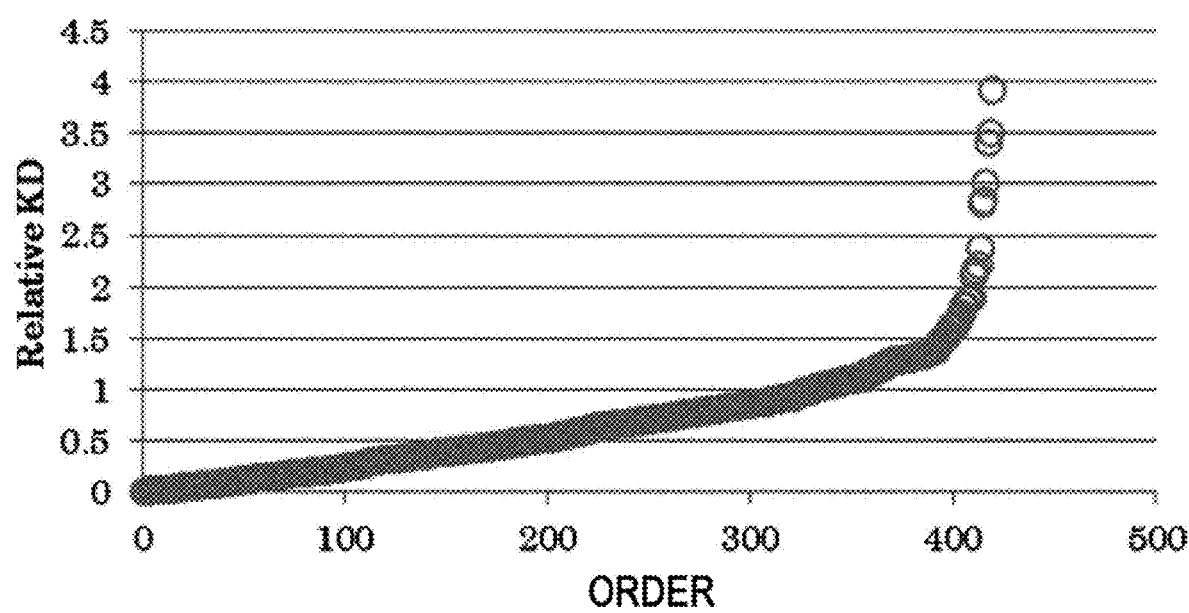

FIG. 39 shows the FcgRIIIa F-binding activity of a point mutant which uses the heterodimerized antibody H240-Kn061/H240-Hl071/L73-k0 as template. Relative KD on the vertical axis shows the value obtained by dividing the KD (mol/L) of H240-Kn061/H240-Hl071/L73-k0 to FcgRIIIa F by the KD of each variant. The numbers on the horizontal axis show the ranks when the Relative KDs are arranged in ascending order.

Figure 40:
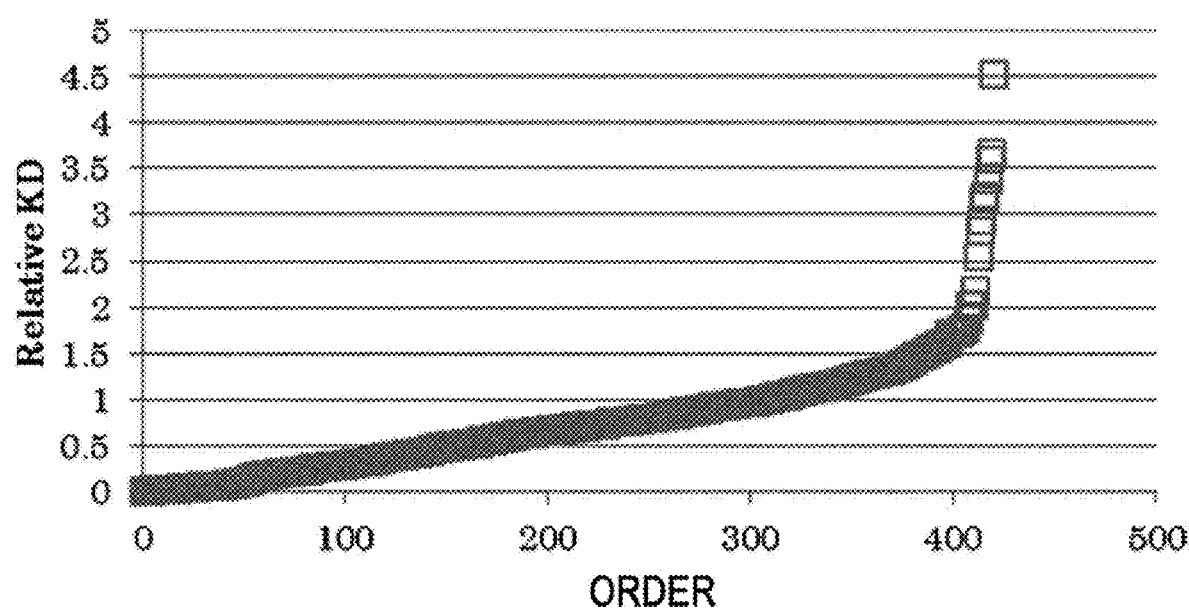

FIG. 40 shows the FcgRIIIa V-binding activity of a point mutant which uses the heterodimerized antibody H240-Kn061/H240-Hl071/L73-k0 as template. Relative KD on the vertical axis shows the value obtained by dividing the KD (mol/L) of H240-Kn061/H240-Hl071/L73-k0 to FcgRIIIa V by the KD of each variant. The numbers on the horizontal axis show the ranks when the Relative KDs are arranged in ascending order.

Figure 41:
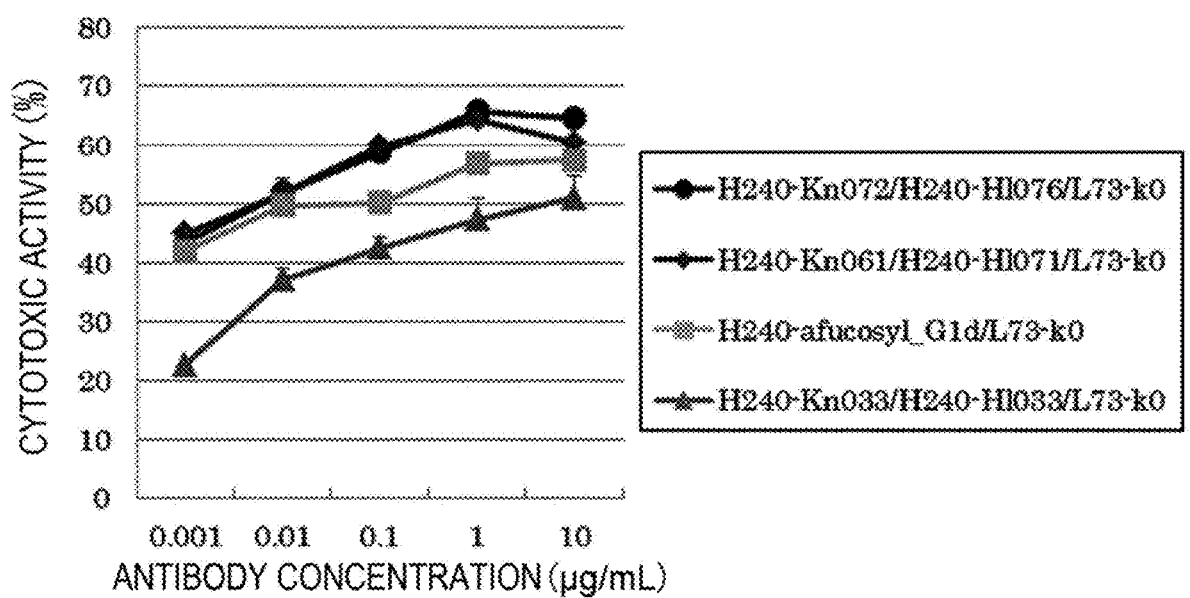

FIG. 41 shows a result of examining the ADCC activity of a heterodimerized antibody, H240-Kn072/H240-Hl076/L73-k0. The cell line used for the evaluation was MIAPaCa-2, and the E/T ratio was 25. Human PBMCs were used as the effector cell. The samples used for the evaluation and their sequences were H240-Kn033/H240-Hl033/L73-k0 (SEQ ID NOs: 84, 85, and 106), H240-Kn061/H240-Hl071/L73-k0 (SEQ ID NOs: 81, 82, and 106), H240-afucosyl_G1d/L73-k0 (SEQ ID NOs: 83 and 106), and H240-Kn072/H240-Hl076/L73-k0 (SEQ ID NOs: 90, 91, and 106). The vertical axis shows antibody cytotoxic activity, and the horizontal axis shows antibody concentration (µg/mL).

Figure 42:
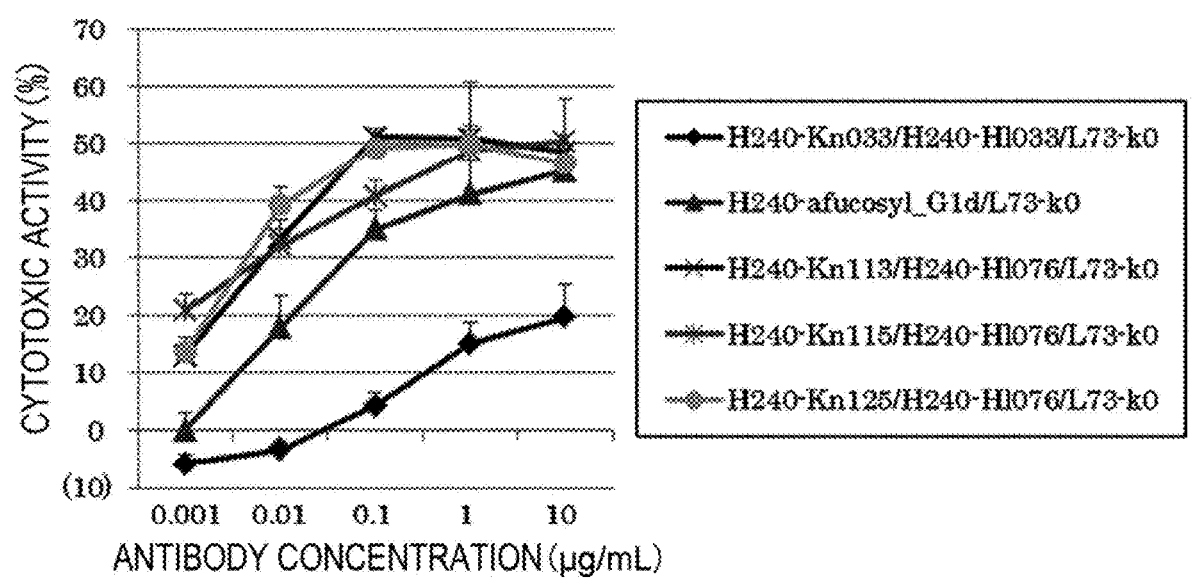

FIG. 42 shows a result of examining the ADCC activity of an improved antibody derived from the heterodimerized antibody H240-Kn072/H240-Hl076/L73-k0. The cell line used for the evaluation was DLD-1, and the E/T ratio was 50. Human PBMCs were used as the effector cell. The samples used for the evaluation and their sequences were H240-Kn033/H240-Hl033/L73-k0 (SEQ ID NOs: 84, 85, and 106), H240-afucosyl_G1d/L73-k0 (SEQ ID NOs: 83 and 106), H240-Kn113/H240-Hl076/L73-k0 (SEQ ID NOs: 92, 91, and 106), H240-Kn115/H240-Hl076/L73-k0 (SEQ ID NOs: 93, 91, and 106), and H240-Kn125/H240-Hl076/L73-k0 (SEQ ID NOs: 94, 91, and 106). The vertical axis shows antibody cytotoxic activity, and the horizontal axis shows antibody concentration (µg/mL).

Figure 43:
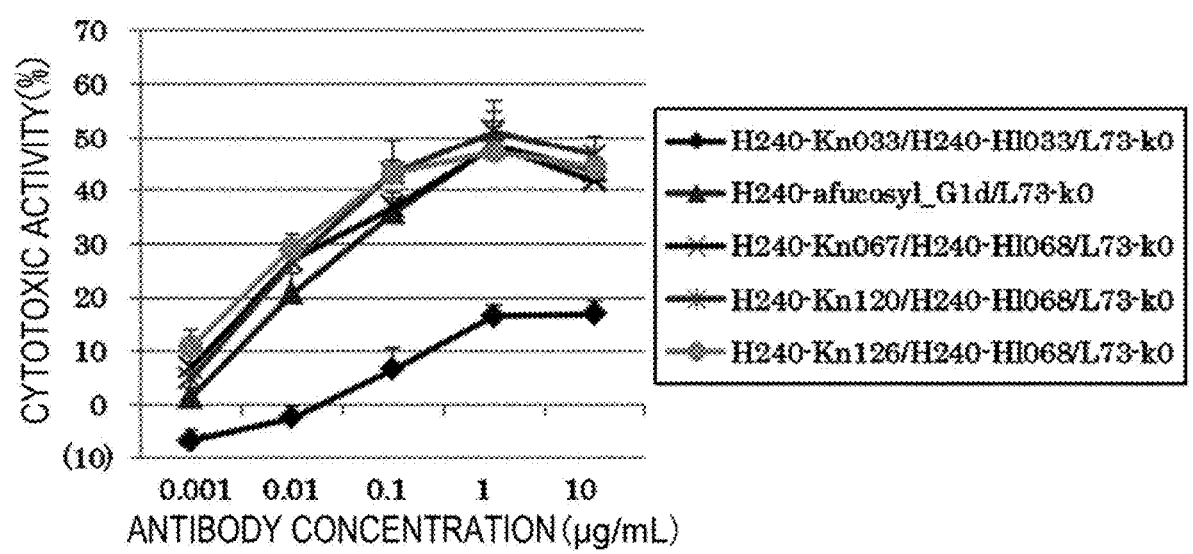

FIG. 43 shows a result of examining the ADCC activity of a heterodimerized antibody, H240-Kn067/H240-Hl068/L73-k0, and such. The cell line used for the evaluation was DLD-1, and the E/T ratio was 50. Human PBMCs were used as the effector cell. The samples used for the evaluation and their sequences were H240-Kn033/H240-Hl033/L73-k0 (SEQ ID NOs: 84, 85, and 106), H240-afucosyl_G1d/L73-k0 (SEQ ID NOs: 83 and 106), H240-Kn067/H240-Hl068/L73-k0 (SEQ ID NOs: 95, 96, and 106), H240-Kn120/H240-Hl068/L73-k0 (SEQ ID NOs: 99, 96, and 106), and H240-Kn126/H240-Hl068/L73-k0 (SEQ ID NOs: 100, 96, and 106). The vertical axis shows antibody cytotoxic activity, and the horizontal axis shows antibody concentration (µg/mL).

Figure 44:
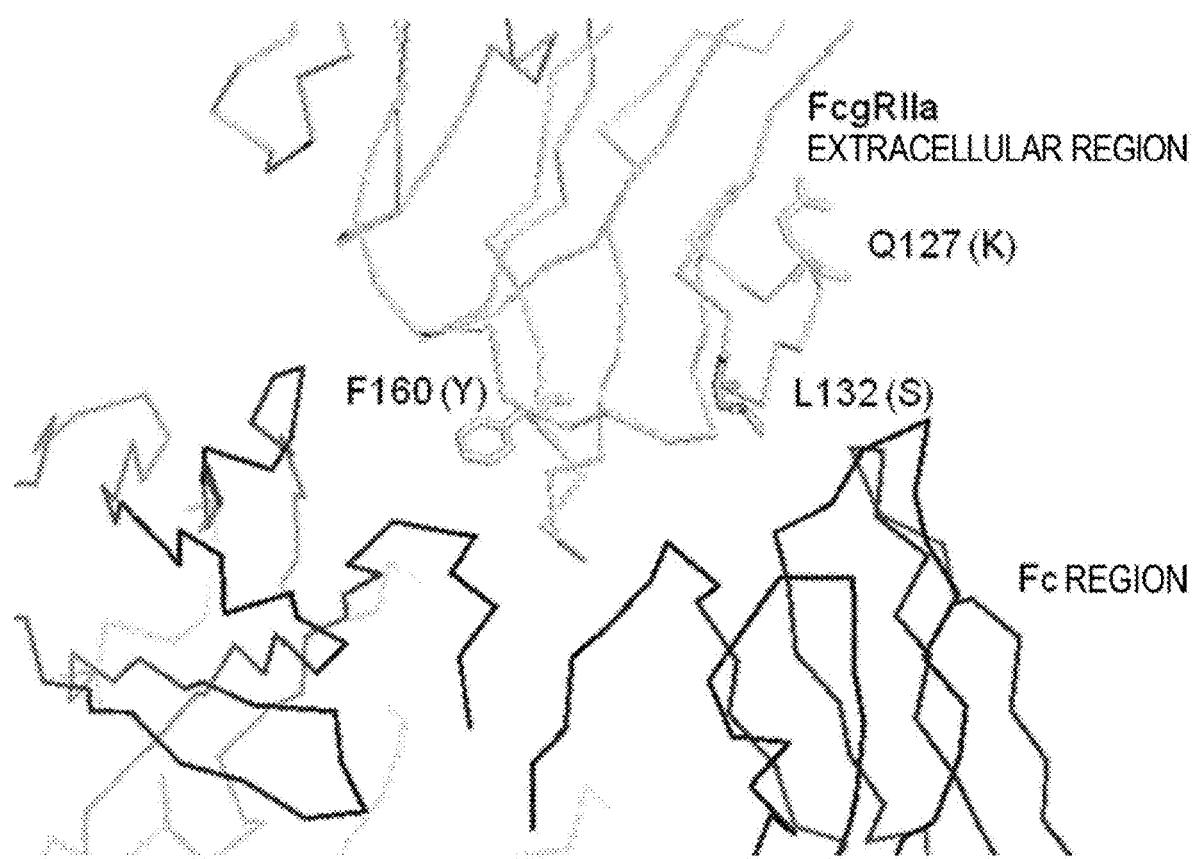

FIG. 44 shows a crystal structure of Fc(WT)/FcgR2a R type (PDB ID=3RY6, J. Imunol. 2011, 187, 3208-321). The figure illustrates side chains of Gln 127, Leu132, and Phe160, which are three residues that differ between FcgRIIa R type and FcgRIIb at the region near the interacting interface between FcgRIIa R type and Fc in this structure. The corresponding amino acid residues in FcgRIIb are shown using one letter codes in parentheses.

Figure 45:
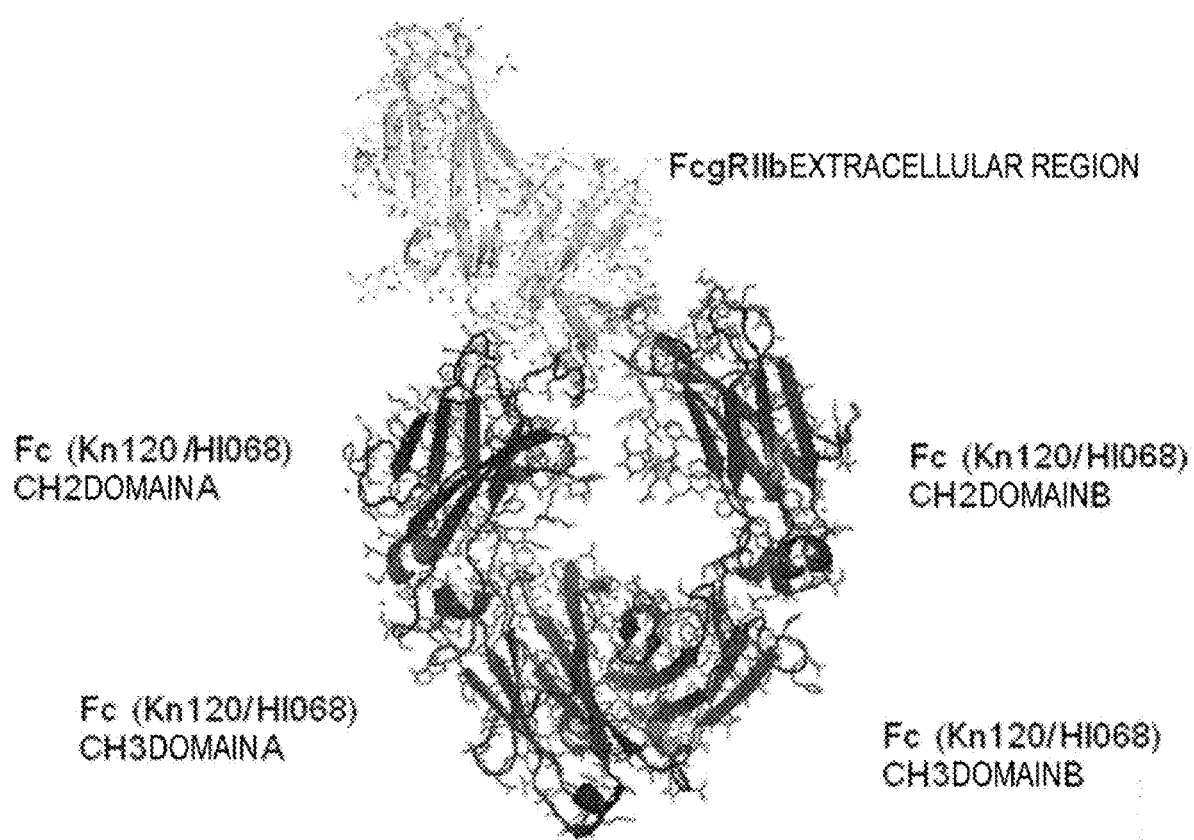

FIG. 45 shows an Fc (Kn120Hl068)/FcgRIIb extracellular domain complex whose structure has been determined by X-ray crystal structure analysis For the CH2 domain and the CH3 domain, those on the left are referred to as domain A and those on the right are referred to as domain B, respectively.

Figure 46:
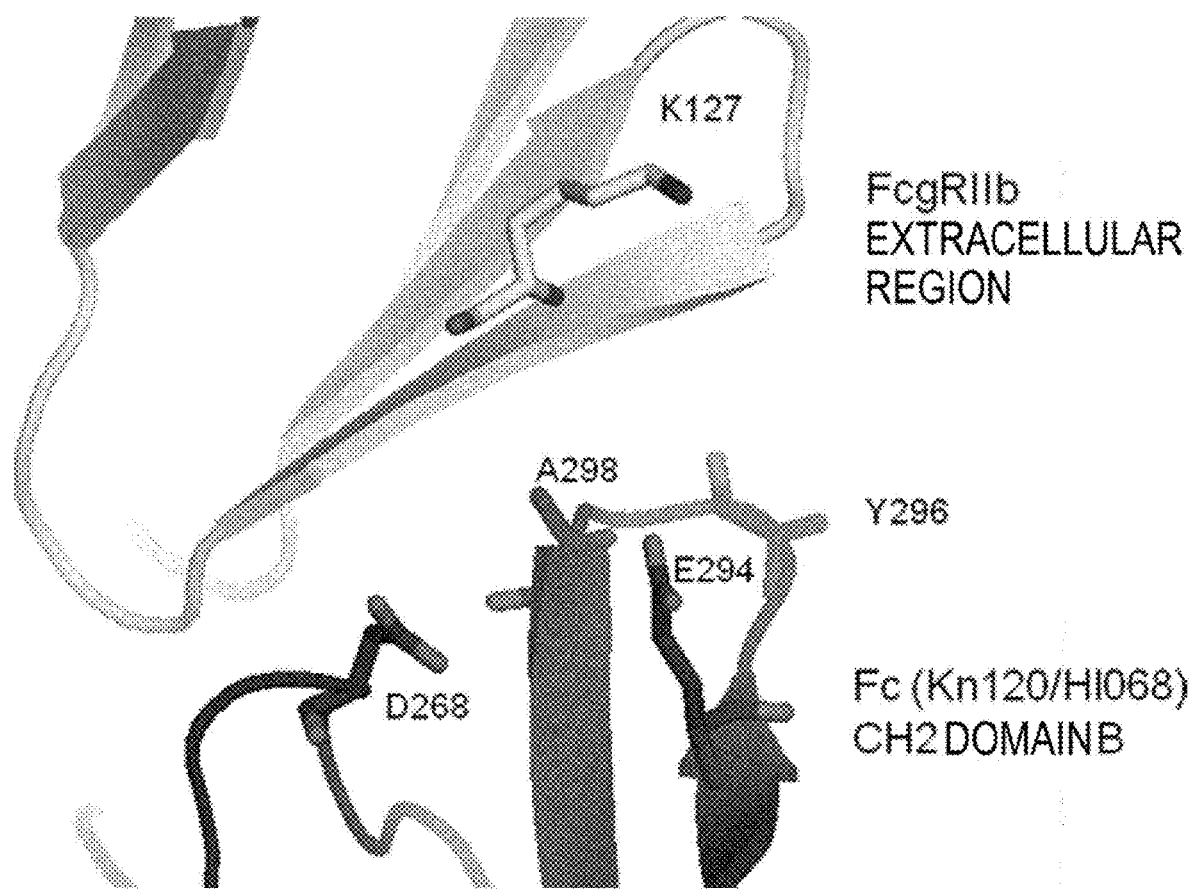

FIG. 46 shows a structure around Lys127 (Gln in FcgRIIa R type) of the FcgRIIb extracellular region in the Fc (Kn120/Hl068)/FcgRIIb extracellular region complex whose structure has been determined by X-ray crystal structure analysis. Since the electron density of the side chain was not observed for Tyr296 of the Fc (Kn120/Hl068), models were not constructed for the side chain other than the Cα atom.

Figure 47:
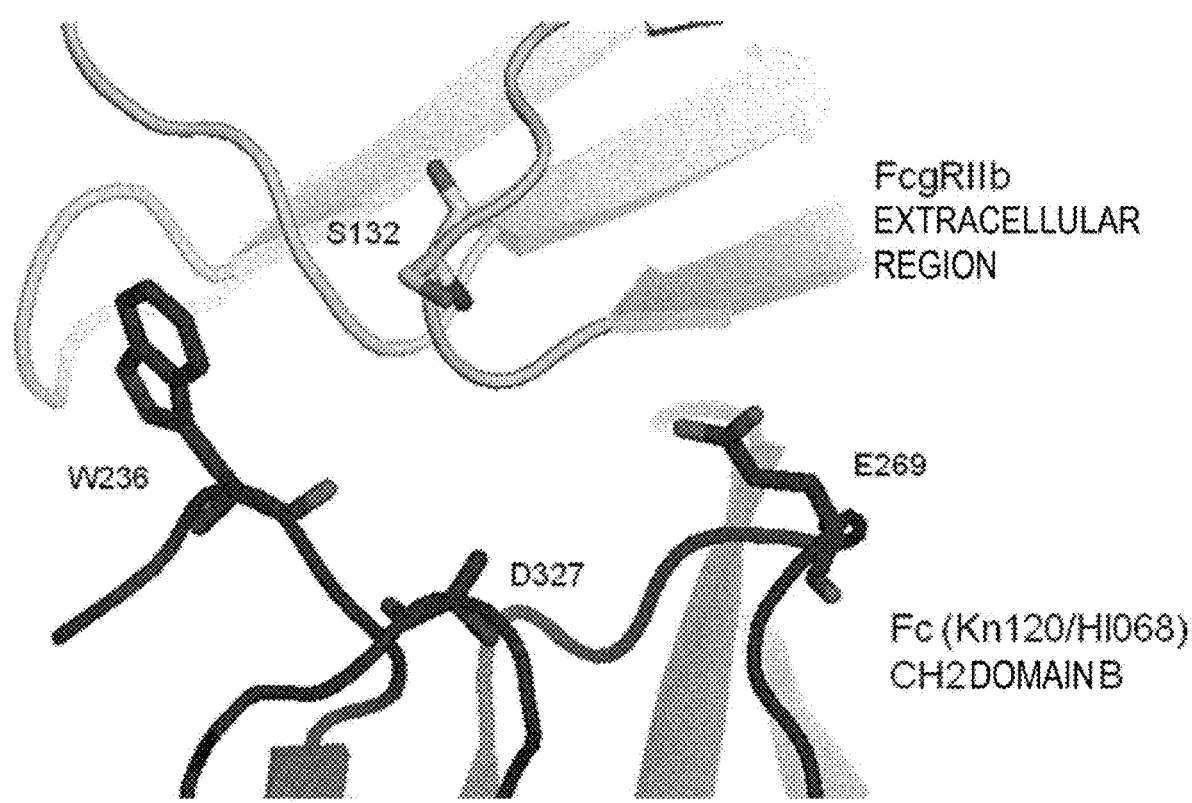

FIG. 47 shows a structure around Ser132 (Leu in FcgRIIa R type) of the FcgRIIb extracellular region in the Fc (Kn120/Hl068)/FcgRIIb extracellular domain complex whose structure has been determined by X-ray crystal structure analysis. Since the electron density of the side chain was not observed for D327 of the Fc (Kn120/Hl068), models were not constructed for the side chain other than the Cα atom.

Figure 48:
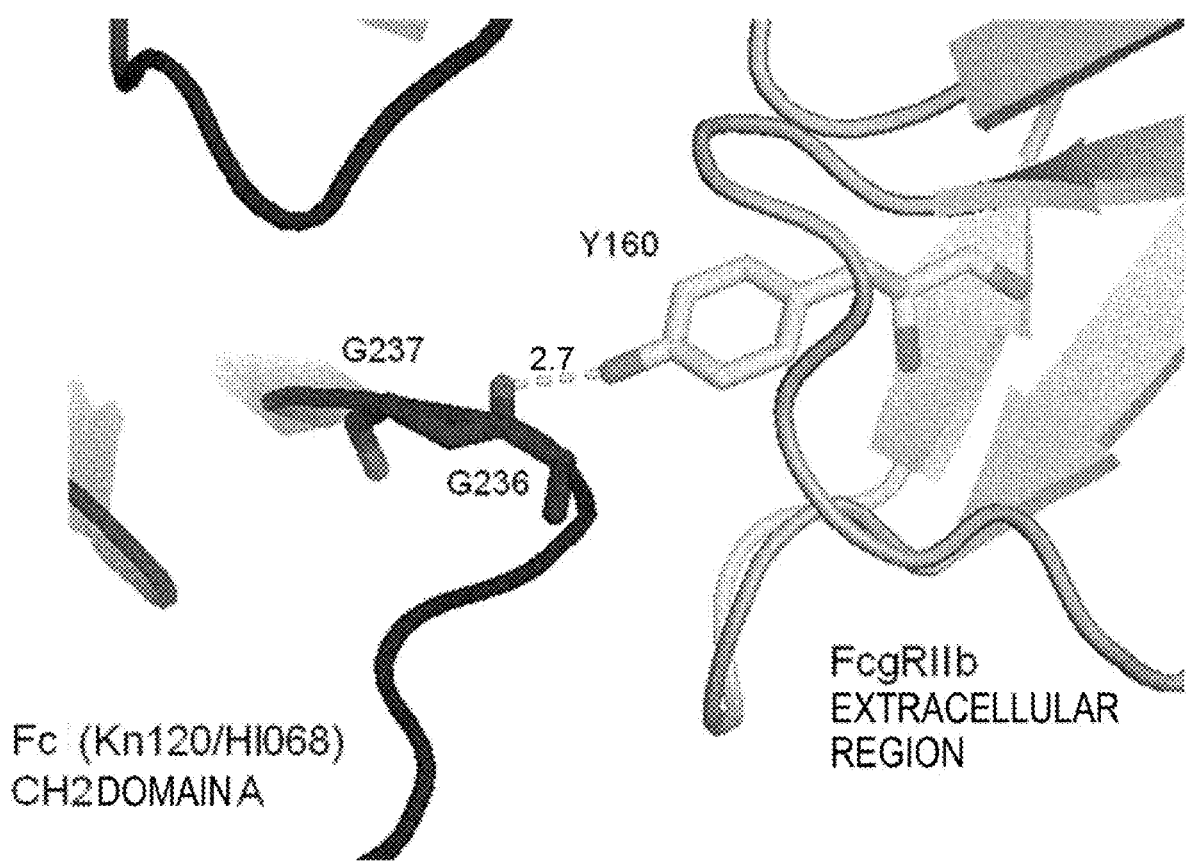

FIG. 48 shows a structure around Tyr160 (Phe in FcgRIIa R type) of the FcgRIIb extracellular region in the Fc (Kn120/Hl068)/FcgRIIb extracellular region complex whose structure has been determined by X-ray crystal structure analysis.

Figure 49:
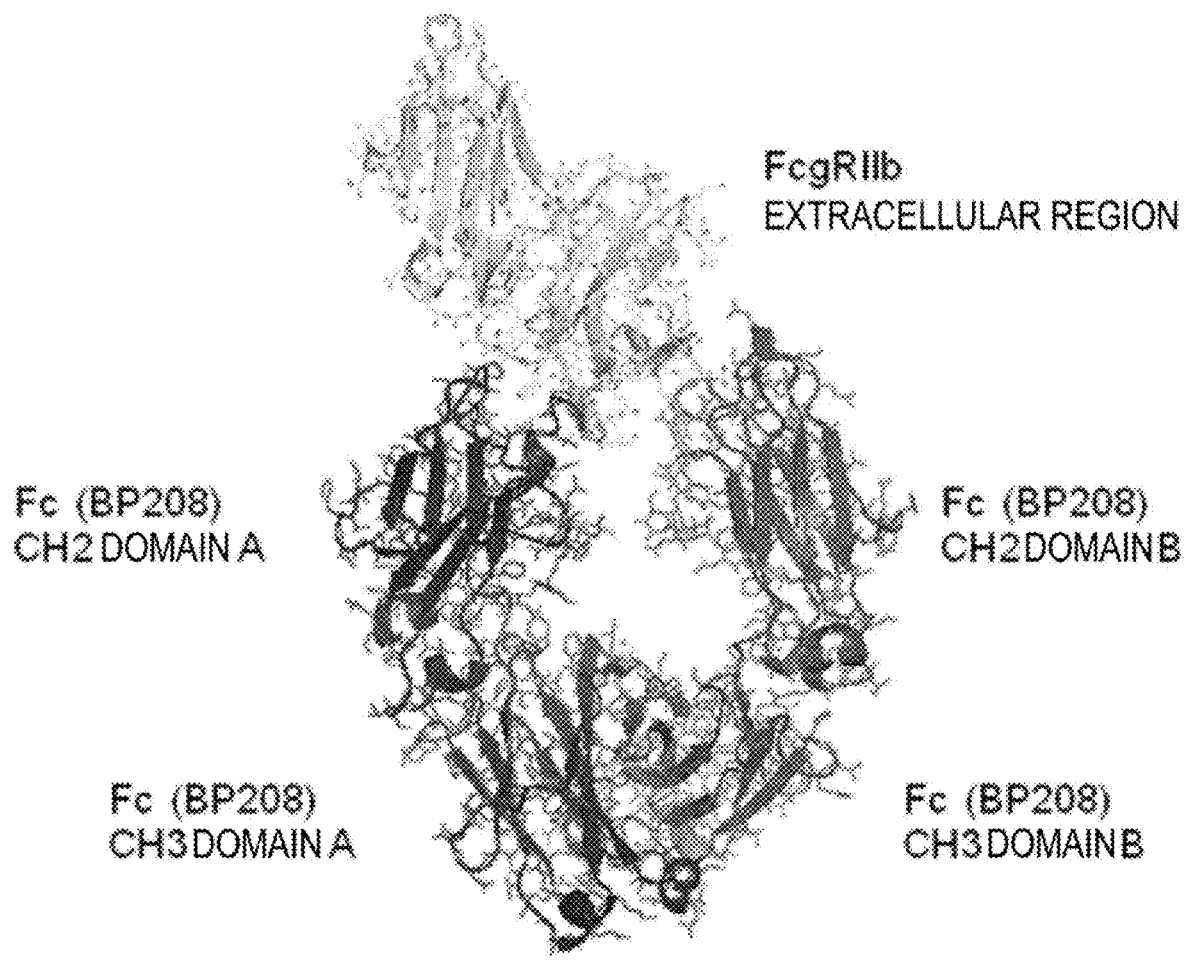

FIG. 49 shows an Fc (BP208)/FcgRIIb extracellular region complex whose structure has been determined by X-ray crystal structure analysis. For the CH2 domain and the CH3 domain, those on the left are referred to as domain A and those on the right are referred to as domain B, respectively.

Figure 50:
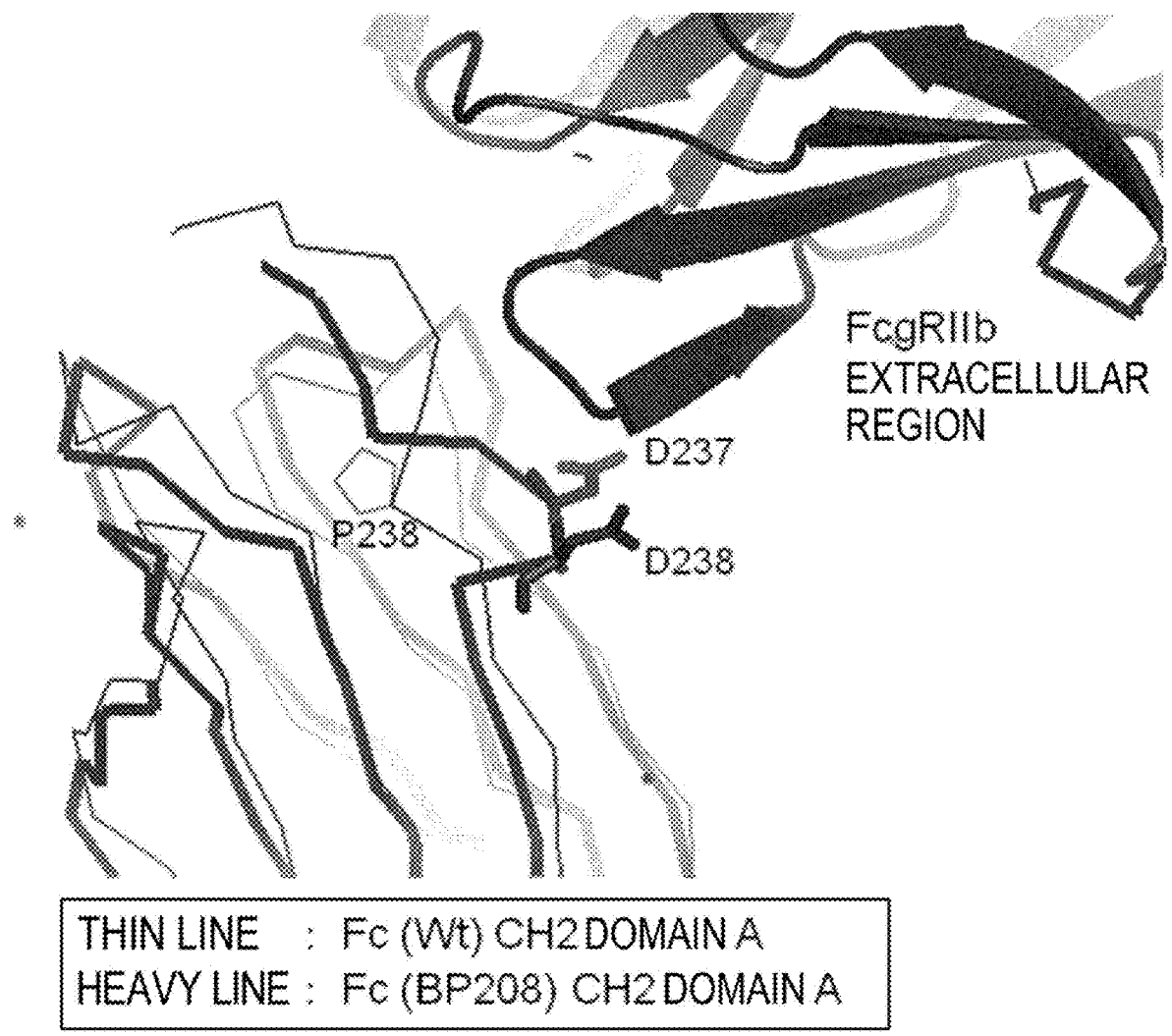

FIG. 50 shows a comparison of CH2 domains A between the structure of the Fc (BP208)/FcgRIIb extracellular region complex determined by X-ray crystal structure analysis and the structure of the Fc (WT)/FcGRIIa extracellular region complex (PDB code: 3RY6) determined by X-ray crystal structure analysis. In the figure, the structure of the Fc (BP208)/FcgRIIb extracellular region complex is depicted by a thick line, and the structure of the Fc (WT)/FcgRIIa extracellular region complex is depicted by a thin line. CH2 domain A alone is illustrated in the structure of the Fc (WT)/FcgRIIa extracellular region complex.

Figure 51:
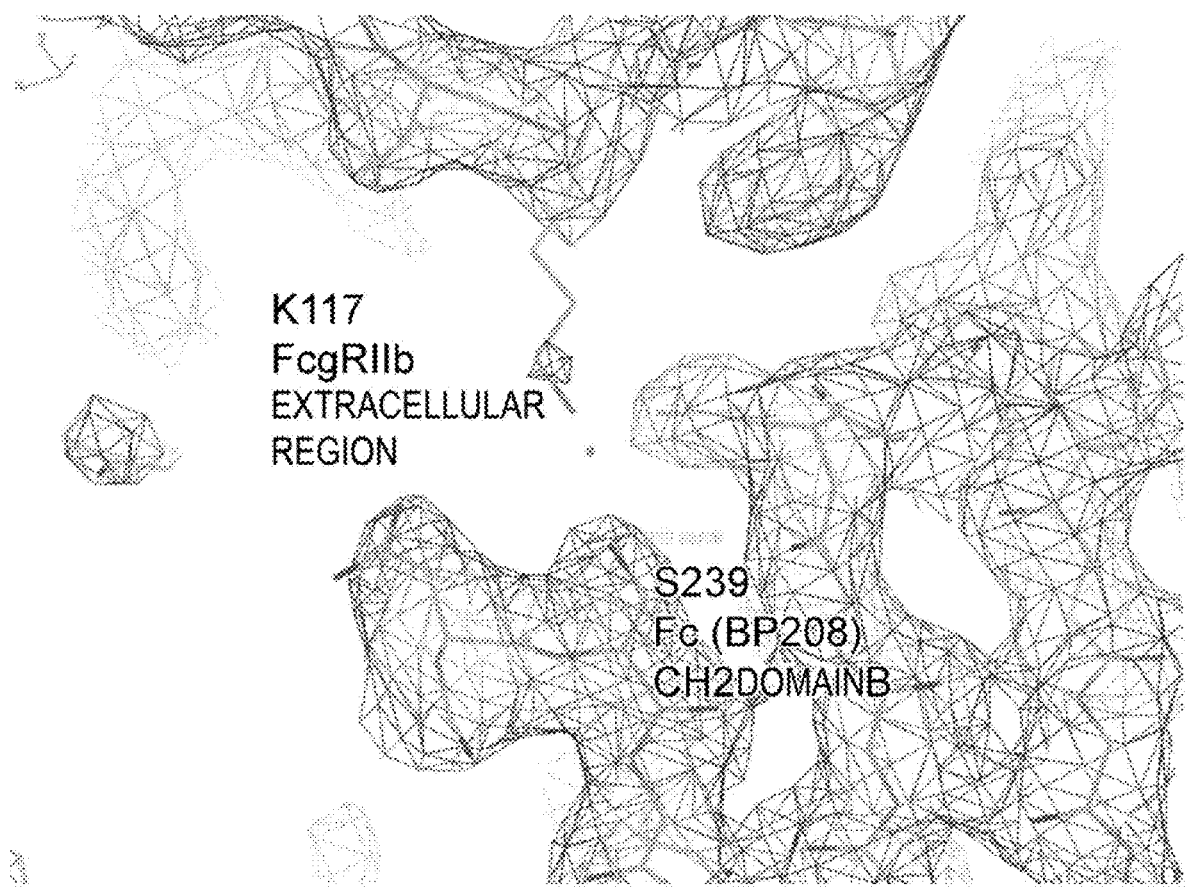

FIG. 51 shows a structure around Ser239 of Fc (BP208) CH2 domain B in the Fc (BP208)/FcgRIIb extracellular region complex, which has been determined by X-ray crystal structure analysis.

Figure 52:
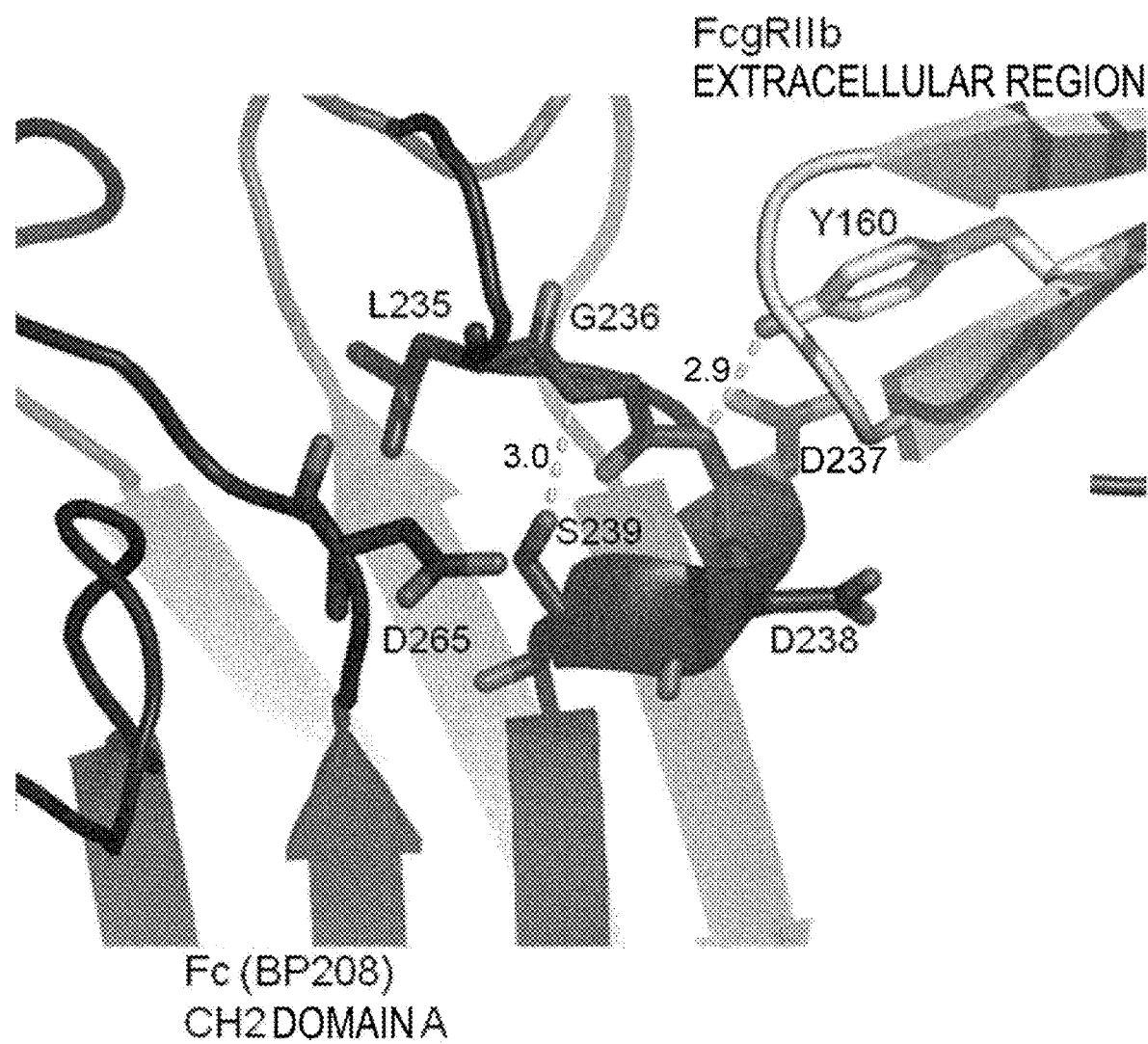

FIG. 52 shows a structure around Ser239 of Fc (BP208) CH2 domain A in the Fc (BP208)/FcgRIIb extracellular region complex, which has been determined by X-ray crystal structure analysis.

Figure 53:
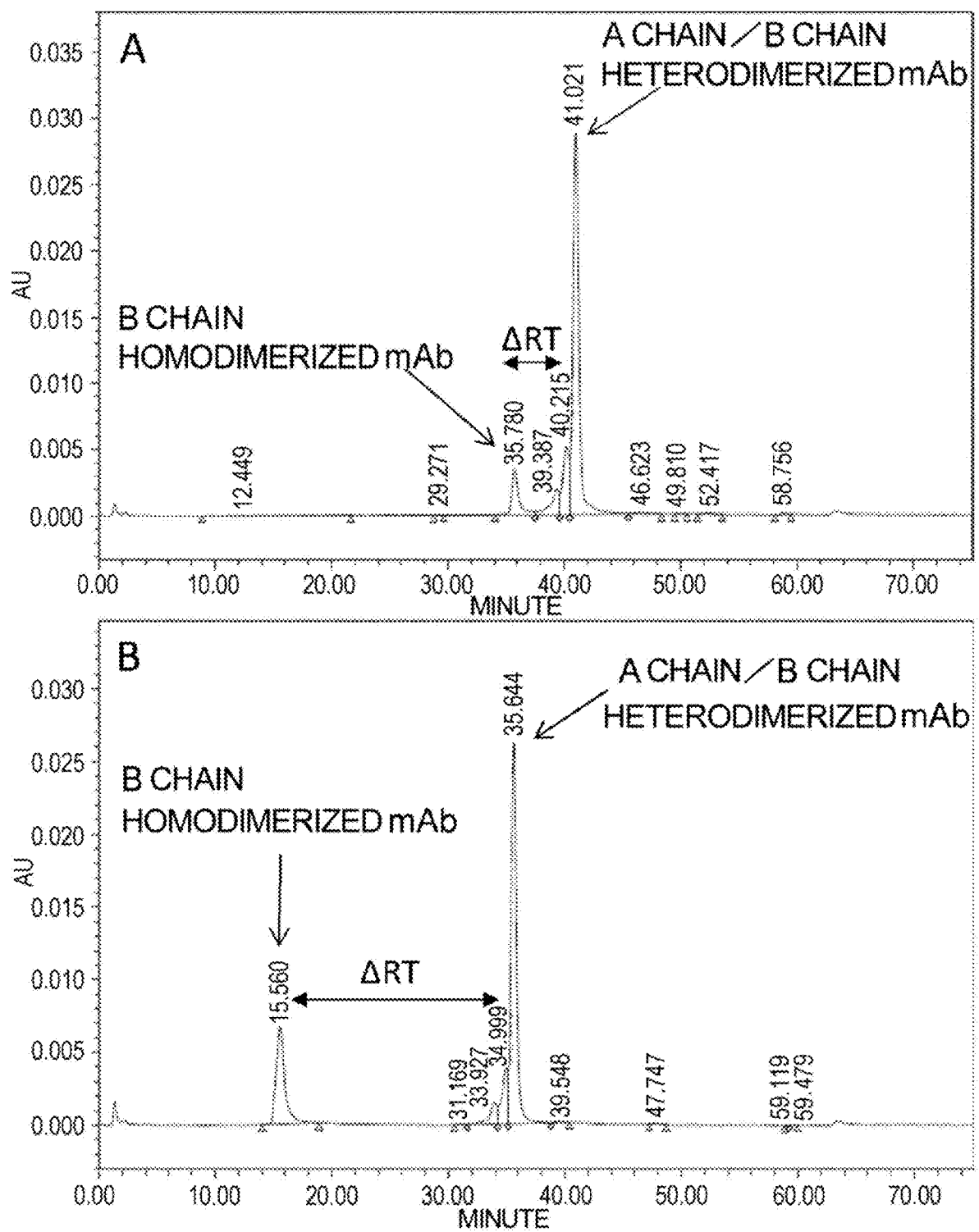

FIG. 53 shows results of analytical cation exchange chromatography for a representative altered antibody, H240-AK072/H240-BH076/L73-k0. A: H240-AK072/H240-BH076/L73-k0; B: H240-FA021/H240-FB084/L73-k0.

Figure 54:
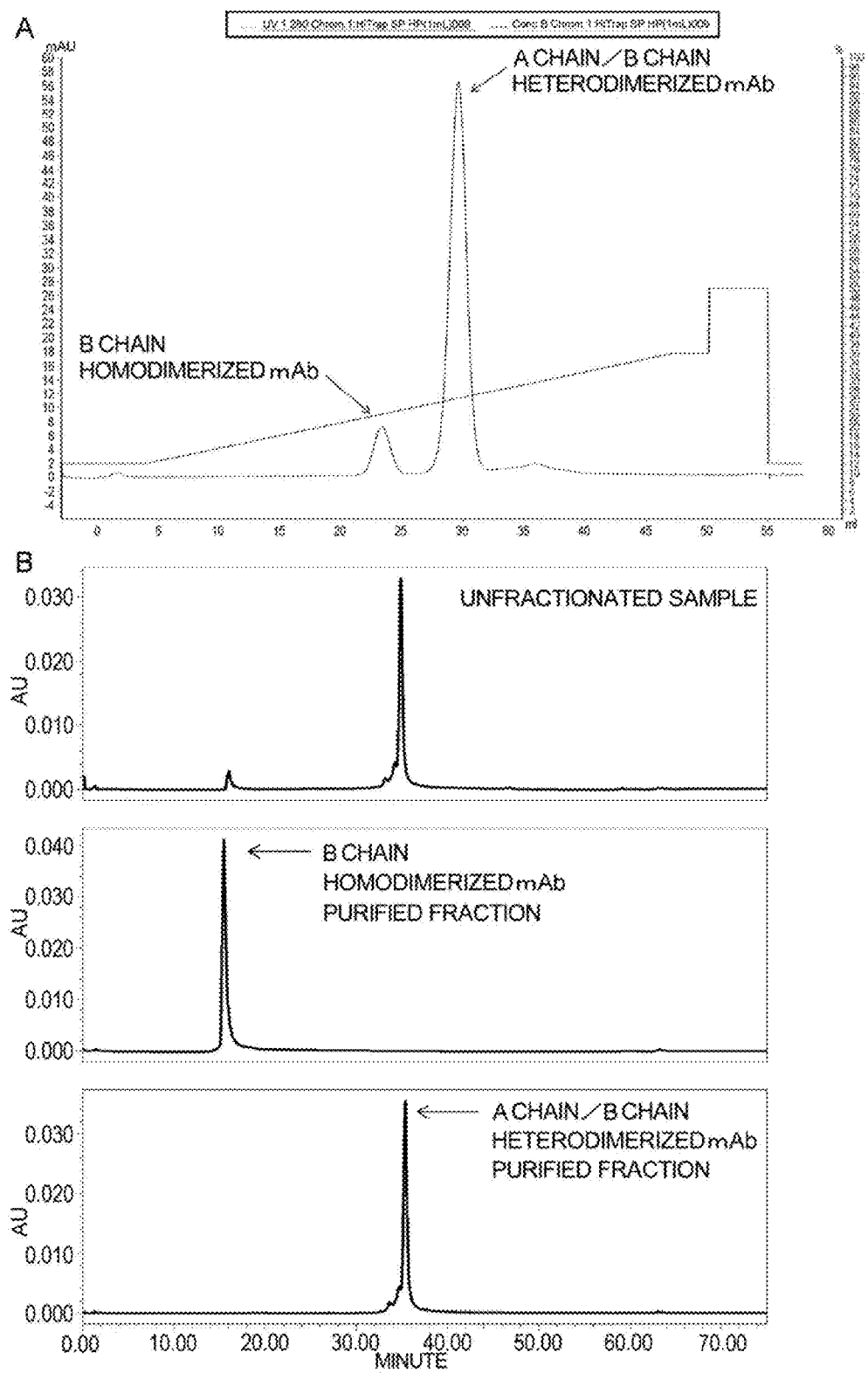

FIG. 54 shows results of cation exchange chromatography for fractionation (A) and analytical cation exchange rechromatography for the collected fractions (B) of H240-FA021/H240-FB084/L73-k0 which is a representative altered antibody, H240-AK072/H240-BH076/L73-k0.

MODE FOR CARRYING OUT THE INVENTION

The following definitions are provided to facilitate understanding of the present invention described herein.

The present invention provides polypeptides characterized in being composed of a heterodimer comprising a first polypeptide and a second polypeptide, wherein the first polypeptide and the second polypeptide comprise an Fc region introduced with mutations, wherein the function of the Fc region is altered compared to a polypeptide comprising an Fc region without the introduction of mutations. The invention further provides methods for producing the polypeptides, and methods for modifying the function of Fc-region-containing polypeptides.

In the present invention, the "polypeptide characterized in being composed of a heterodimer comprising a first polypeptide and a second polypeptide" may be a polypeptide complex composed of a first polypeptide and a second polypeptide, as well as other multiple polypeptides.

Herein, "first polypeptide" and "second polypeptide" mean polypeptides constituting an antibody Fc region. The terms "first polypeptide" and "second polypeptide" means that their sequences are different from each other, and preferably at least the CH2 domain sequences are different. The polypeptides may be, for example, polypeptides that constitute the Fc region of a naturally-occurring IgG, or polypeptides produced by altering the polypeptides constituting the Fc region of a naturally-occurring (native) IgG.

"Naturally-occurring IgGs" refers to polypeptides that belong to a class of antibodies practically encoded by immunoglobulin gamma genes and comprise an amino acid sequence identical to those of IgGs found in nature. For example, a naturally-occurring human IgG refers to a naturally-occurring human IgG1, naturally-occurring human IgG2, naturally-occurring human IgG3, naturally-occurring human IgG4, or such. Naturally-occurring IgGs also include mutants spontaneously produced from them.

"Polypeptides" of the present invention generally refers to peptides or proteins approximately ten amino acids or more in length. Furthermore, they are generally polypeptides derived from organisms, but are not particularly limited, and for example, they may be polypeptides comprising an artificially designed sequence. Furthermore, they may be any of naturally-occurring polypeptides, synthetic polypeptides, recombinant polypeptides, or such. Protein molecules of the present invention refer to molecules comprising the polypeptide.

Preferred examples of the polypeptides of the present invention include antibodies. More preferred examples include naturally-occurring IgGs, particularly naturally-occurring human IgGs. "Naturally-occurring IgGs" refers to polypeptides belonging to a class of antibodies practically encoded by immunoglobulin gamma genes and comprising an amino acid sequence identical to those of IgGs found in nature. For example, a naturally-occurring human IgG means a naturally-occurring human IgG1, naturally-occurring human IgG2, naturally-occurring human IgG3, naturally-occurring human IgG4, or such. Naturally-occurring IgGs also include mutants spontaneously produced from them.

While an IgK (Kappa, κ chain), IgL1, IgL2, IgL3, IgL6, and IgL7 (Lambda, λ chain)-type constant region is present in the antibody light chain constant region, it may be any light chain constant region. For the human IgK (Kappa) constant region and human IgL7 (Lambda) constant region, a plurality of allotype sequences due to genetic polymorphism are described in "Sequences of proteins of immunological interest", NIH Publication No. 91-3242, and any of them may be used in the present invention. Furthermore, in the present invention, a light chain constant region may be a light chain constant region that has been altered with amino acid substitutions, additions, deletions, insertions, and/or modifications or such. For the antibody Fc region, for example, Fc regions of the IgA1, IgA2, IgD, IgE, IgG1, IgG2, IgG3, IgG4, and IgM types exist. For example, a human IgG antibody Fc region can be used as the antibody Fc region of the present invention, and human IgG1 antibody Fc regions are preferred. Fc regions that can be used as an Fc region of the present invention are, for example, those derived from naturally-occurring IgG constant regions, or specifically, a constant region derived from naturally-occurring human IgG1 (SEQ ID NO: 76), a constant region derived from naturally-occurring human IgG2 (SEQ ID NO: 77), a constant region derived from naturally-occurring human IgG3 (SEQ ID NO: 78), and a constant region derived from naturally-occurring human IgG4 (SEQ ID NO: 79). FIG. 32 shows the constant region sequences of the naturally-occurring IgG1, IgG2, IgG3, and IgG4. Constant regions of naturally-occurring IgGs also include mutants spontaneously produced from them. For the constant regions of human IgG1, human IgG2, human IgG3, and human IgG4 antibodies, a plurality of allotype sequences due to genetic polymorphism are described in "Sequences of proteins of immunological interest", NIH Publication No. 91-3242, and any of them may be used in the present invention. In particular, for the human IgG1 sequence, the amino acid sequence at positions 356 to 358 (EU numbering) may be either DEL or EEM.

Furthermore, the strength of interaction between an antibody Fc region and FcγR has been reported to depend on $Zn^{2+}$ ion concentration (Immunology Letters 143 (2012) 60-69). The antibody shows a stronger interaction between the Fc region and FcgR when the $Zn^{2+}$ ion concentration of the Fc region is higher. Chelation of $Zn^{2+}$ by His310 and His435 present in CH3 of the antibody Fc region opens up each CH2 domain of the Fc region at a distal position. This facilitates interaction between the CH2 domain and FcgR, and the interaction between the Fc region and FcgR is enhanced. A non-limiting embodiment of the Fc region of the present invention includes an Fc region in which His at position 310, His at position 435, His at position 433, and/or Asn at position 434 (EU numbering) is chelated with $Zn^{2+}$.

In the present invention, "Fc region" refers to a region consisted of a hinge region or a part thereof, a CH2 domain, and a CH3 domain in an antibody molecule. According to EU numbering (herein, also called the EU INDEX), an IgG-class Fc region refers to, for example, a region from cysteine at position 226 to the C terminus, or from proline at position 230 to the C terminus, but is not limited thereto.

The Fc region may be obtained preferably by re-eluting fractions adsorbed onto a protein A column or protein G column after partially digesting IgG1, IgG2, IgG3, IgG4 monoclonal antibodies or such using a protease such as pepsin. The protease is not particularly limited as long as it can digest a full-length antibody so as to produce Fab and F(ab')2 in a restrictive manner by appropriately setting the enzyme reaction conditions such as pH; and examples include pepsin and papain.

Herein, "heterodimerization" means constituting a single polypeptide from two polypeptides with different amino acid sequences, and "heterodimer" means a polypeptide composed of two polypeptides with different amino acid sequences. Furthermore, "homodimerization" means constituting a single polypeptide from two polypeptides having the same amino acid sequences, and "homodimer" means a polypeptide composed of two polypeptides having the same amino acid sequences; or a polypeptide composed of polypeptides having the same amino acid sequences excluding alterations made for the purpose of efficient heterodimerization or alterations made for the purpose of efficient purification of heterodimers; or a polypeptide composed of polypeptides comprising the same amino acids excluding alterations that have not been made for the purpose of improving Fc function. In the present invention, "heterodimer" or "homodimer" preferably means "heterodimerization" or "homodimerization" for the Fc region, or preferably means "heterodimerization" or "homodimerization" for CH2 in the Fc region. Furthermore, "parent polypeptide" means a polypeptide before introduction of alterations such as amino acid mutations.

The amino acid mutation of the present invention may be used alone or in combination with multiple amino acid mutations.

When multiple amino acid mutations are used in combination, the number of mutations combined is not particularly limited, and can be set appropriately within a range that can achieve the objectives of the invention, and examples include two or more to 30 or less, and preferably two or more to 15 or less.

When multiple amino acid mutations are combined, the amino acid mutations may be introduced into only one of the two polypeptides constituting the Fc region, or they may be appropriately distributed to both of the two polypeptides.

Furthermore, in the present invention, to achieve a higher function-modifying effect in the Fc region, it is preferable to introduce at least one amino acid mutation that improves the Fc region function when the mutation is introduced into only one of the polypeptides, compared to when no mutation is introduced and when the mutation is introduced into both Fc regions of the two polypeptides.

The site to be altered is not particularly limited as long as it is in an Fc region, and it can be appropriately set within a range that can achieve the objectives of the present invention; and examples include the hinge region, CH2 region, and CH3 region.

More preferably, the site to be altered is a CH2 domain. CH2 domain refers to positions 231 to 340 (EU numbering), and CH3 domain refers to positions 341 to 447 (EU numbering). For example, when introducing mutations into the amino acid sequence of a constant region derived from human IgG1, amino acid residues at one or more positions selected from among 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, and 447 (EU numbering) may be altered.

More specifically, when introducing alterations into the amino acid sequence of a human IgG1 constant region, amino acid residues at one or more positions selected from among 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 390, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, and 447 (EU numbering) may be altered.

More specifically, when introducing alterations into the amino acid sequence of a human IgG1 constant region, amino acid residues at one or more positions selected from among 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, 316, 317, 318, 319, 320, 321, 322, 323, 324, 325, 326, 327, 328, 329, 330, 331, 332, 333, 334, 335, 336, 337, 338, 339, and 340 (EU numbering) may be altered.

More specifically, when introducing alterations into the amino acid sequence of a human IgG1 constant region, amino acid residues at one or more positions selected from among 231, 232, 233, 234, 235, 236, 237, 238, 239, 240, 265, 266, 267, 268, 269, 270, 271, 295, 296, 298, 300, 324, 325, 326, 327, 328, 329, 330, 331, 332, 333, 334, 335, 336, and 337 (EU numbering) may be altered.

In the present invention, amino acid alteration means any of substitution, deletion, addition, insertion, and modification, or a combination thereof. In the present invention, amino acid alteration may be rephrased as amino acid mutation, and they are used synonymously.

Substitution

When substituting amino acid residues, substitution to a different amino acid residue is carried out with the objective of altering aspects such as (a)-(c) described below:
(a) polypeptide backbone structure in the sheet-structure or helical-structure region;
(b) electric charge or hydrophobicity at the target site; or
(c) size of the side chain.

Amino acid residues are classified into the following groups based on their general side chain properties:
(1) hydrophobic: norleucine, met, ala, val, leu, and ile;
(2) neutral hydrophilic: cys, ser, thr, asn, and gln;
(3) acidic: asp and glu;
(4) basic: his, lys, and arg;
(5) residues that affect the chain orientation: gly and pro; and
(6) aromatic: trp, tyr, and phe.

Substitution between amino acid residues within each of these amino acid groups is referred to as conservative substitution, and amino acid residue substitution between different groups is referred to as non-conservative substitution.

Substitutions in the present invention may be conservative substitutions or non-conservative substitutions, or a combination of conservative substitutions and non-conservative substitutions.

In addition to the amino acid mutations introduced based on the present invention, polypeptides of the present invention may further comprise additional alterations. For example, additional alterations may be selected from any of amino acid substitutions, deletions, and modifications, or combinations thereof.

For example, polypeptides of the present invention can be arbitrarily altered within a range that does not practically change the intended function of the polypeptide. When the polypeptide of the present invention is an antibody, its heavy chain and light chain can be altered. For example, such mutations can be performed through conservative substitution of amino acid residues. Furthermore, even if an alteration changes the intended function of a polypeptide of the present invention, the alteration may also be carried out as long as the change in the function is in a range within the objectives of the present invention.

Amino acid sequence alteration of the present invention includes post-translational modification. A specific post-translational modification may be addition or deletion of a sugar chain. For example, in the IgG1 constant region, the amino acid residue at position 297 (EU numbering) may be sugar chain-modified. The sugar-chain structure for the modification is not limited. Generally, antibodies expressed in eukaryotic cells comprise glycosylation in the constant region. Therefore, antibodies expressed in cells such as those below are normally modified by some type of sugar chain:

antibody-producing cells of mammals
eukaryotic cells transformed with an expression vector comprising a DNA encoding an antibody Eukaryotic cells shown here include yeast and animal cells. For example, CHO cells and HEK293H cells are representative animal cells used in transformation with an expression vector comprising an antibody-encoding DNA. On the other hand, those without glycosylation at this site are also included in the antibody of the present invention. Antibodies whose constant region is not glycosylated can be obtained by expressing an antibody-encoding gene in prokaryotic cells such as *Escherichia coli*.

In the present invention, additional alterations specifically include, for example, addition of sialic acid to the sugar chain of an Fc region (MAbs. 2010 September-October; 2(5): 519-27).

When the polypeptide of the present invention is an antibody, for example, amino acid substitutions that improve FcRn-binding activity (J. Immunol. 2006 Jan. 1; 176(1): 346-56; J Biol Chem. 2006 Aug. 18; 281(33): 23514-24; Int. Immunol. 2006 December; 18(12): 1759-69; Nat Biotechnol. 2010 February; 28(2): 157-9; WO/2006/019447; WO/2006/053301; and WO/2009/086320), and amino acid substitutions for improving antibody heterogeneity or stability (WO/2009/041613) may be introduced into an antibody constant region portion.

To produce a heterodimerized polypeptide of the present invention, it is required that polypeptides having amino acids that differ from each other are associated, or a heterodimerized polypeptide of interest is separated from other homodimerized polypeptides.

For association of polypeptides having different amino acids from each another and comprising an Fc region, a technique of suppressing unintended association between H chains by introducing electrostatic repulsion into the interface of the second constant region of the antibody H chain (CH2) or the third constant region of the H chain (CH3) (WO 2006/106905) can be applied.

In the technology of suppressing unintended association between H chains by introducing electrostatic repulsion into the interface of CH2 or CH3, examples of amino acid residues in contact at the interface of other constant regions of the H chain include the residue at position 356 (EU numbering), the residue at position 439 (EU numbering), the region facing the residue at position 357 (EU numbering), the residue at position 370 (EU numbering), the residue at position 399 (EU numbering), and the residue at position 409 (EU numbering) in the CH3 domain.

More specifically, for example, in an antibody containing two types of H chain CH3 domains, the antibody in which one to three pairs of amino acid residues selected from the amino acid residues shown below in (1) to (3) in the first H chain CH3 domain have the same type of charge can be produced:
(1) amino acid residues at positions 356 and 439 (EU numbering) which are amino acid residues contained in the H chain CH3 domain;
(2) amino acid residues at positions 357 and 370 (EU numbering) which are amino acid residues contained in the H chain CH3 domain; and
(3) amino acid residues at positions 399 and 409 (EU numbering) which are amino acid residues contained in the H chain CH3 domain.

Furthermore, an antibody can be produced in which one to three pairs of amino acid residues corresponding to the amino acid residue pairs indicated above in (1) to (3) having the same type of charge in the first H chain CH3 domain have charges opposite to the corresponding amino acid residues in the aforementioned first H chain CH3 domain, wherein the amino acid residue pairs are selected from the amino acid residue pairs indicated above in (1) to (3) in the second H chain CH3 domain which differs from the first H chain CH3 domain.

The respective amino acid residues of (1) to (3) mentioned above are positioned close to each other when associated. Those skilled in the art can find sites that correspond to the above-mentioned amino acid residues of (1) to (3) by homology modeling and such using commercially available software for the desired H chain CH3 domain or H chain constant region, and amino acid residues of these sites can be altered when appropriate.

In the above-mentioned antibodies, for example, "charged amino acid residues" are preferably selected from amino acid residues included in either of groups (X) or (Y) below:
(X) glutamic acid (E) and aspartic acid (D); and
(Y) lysine (K), arginine (R), and histidine (H).

In the above-mentioned antibodies, the phrase "having the same type of charge" means that, for example, all of the two or more amino acid residues are amino acid residues included in either of the above-mentioned groups (X) and (Y). The phrase "having the opposite charge" means that, for example, when at least one of the two or more amino acid residues is an amino acid residue included in either one of the above-mentioned groups (X) and (Y), the remaining amino acid residues are amino acid residues included in the other group.

In a preferred embodiment of the above-mentioned antibody, the first H chain CH3 domain and the second H chain CH3 domain may be cross-linked by disulfide bonds.

In the present invention, the amino acid residues to be altered are not limited to amino acid residues of the antibody constant region or antibody variable region described above. Those skilled in the art can find amino acid residues that form the interface in polypeptide mutants or heteromultimers through homology modeling and such using commercially available software, and can alter the amino acid residues at those sites to regulate association.

Other known technologies can also be used for the association of polypeptides of the present invention having different amino acids and comprising an Fc region. Polypeptides having different amino acids and comprising an Fc region can be efficiently associated with each other by substituting an amino acid side chain present in one of the H chain variable regions of the antibody with a larger side chain (knob), and substituting an amino acid side chain present in the opposing variable region of the other H chain with a smaller side chain (hole), to allow placement of the knob within the hole (WO 1996/027011; and Ridgway J B et al., Protein Engineering (1996) 9, 617-621; Merchant A M et al. Nature Biotechnology (1998) 16, 677-681).

In addition, other known technologies can also be used for the association of polypeptides having different amino acids and comprising an Fc region. Association of polypeptides having different sequences can be induced efficiently by complementary association of CH3, by using a strand-exchange engineered domain CH3 produced by changing part of the CH3 in one of the H chains of an antibody into an IgA-derived sequence corresponding to that portion, and introducing a corresponding IgA-derived sequence into the complementary portion of the CH3 on the other H chain (Protein Engineering Design & Selection, 23; 195-202, 2010). This known technology can also be used to efficiently induce association of polypeptides having different amino acids and comprising an Fc region.

In addition, one can also use technologies for heterodimerized antibody production using association of antibody CH1 and CL, and association of VH and VL, which are described in WO 2011/028952.

Furthermore, even in cases where heterodimerized polypeptides cannot be formed efficiently, heterodimerized polypeptides can be obtained by separating and purifying them from homodimerized polypeptides. When producing a heterodimerized polypeptide consisting of a first polypeptide and a second polypeptide which have different sequences from each other, homodimerized polypeptides consisting of only two first polypeptides, and homodimerized polypeptide consisting of only two second polypeptide are mixed in as impurities. Known technologies can be used as a method for efficiently removing these two types of homodimerized polypeptides. A method has been reported to be able to purify two types of homodimers and the heterodimerized antibody of interest by ion exchange chromatography, by creating a difference in isoelectric points by introducing amino acid substitutions into the variable regions of the two types of H chains (WO 2007114325). To date, as a method for purifying heterodimerized antibodies, a method using Protein A has been reported to purify a heterodimerized antibody comprising a mouse IgG2a H chain that binds to Protein A and a rat IgG2b H chain that does not bind to Protein A (WO 98050431 and WO 95033844).

Furthermore, a heterodimerized antibody alone can be efficiently purified by using H chains in which amino acid residues at the IgG-Protein A binding site, positions 435 and 436 (EU numbering), are substituted with amino acids yielding different Protein A affinities such as Tyr or His to change interaction of each of the H chains with Protein A, and using a Protein A column.

A plurality of these substitutions and technologies, for example, two or more of them can be used in combination. Furthermore, these alterations can be made separately to the first polypeptide and the second polypeptide when necessary. Polypeptides of the present invention may also be those produced based on the products of the above-mentioned alterations.

Amino acid sequence can be altered by various methods known to those skilled in the art. Such methods include the site-directed mutagenesis method (Hashimoto-Gotoh, T, Mizuno, T, Ogasahara, Y, and Nakagawa, M. (1995) An oligodeoxyribonucleotide-directed dual amber method for site-directed mutagenesis. Gene 152: 271-275; Zoller, M J, and Smith, M. (1983) Oligonucleotide-directed mutagenesis of DNA fragments cloned into M13 vectors. Methods Enzymol. 100: 468-500; Kramer, W, Drutsa, V, Jansen, H W, Kramer, B, Pflugfelder, M, and Fritz, H J (1984) The gapped duplex DNA approach to oligonucleotide-directed mutation construction. Nucleic Acids Res. 12: 9441-9456; Kramer W, and Fritz H J (1987) Oligonucleotide-directed construction of mutations via gapped duplex DNA Methods. Enzymol. 154, 350-367; and Kunkel, T A (1985) Rapid and efficient site-specific mutagenesis without phenotypic selection. Proc Natl Acad Sci USA. 82: 488-492), the PCR mutation method, and the cassette mutation method, but are not limited thereto.

In the present invention, the phrase "Fc region function" refers to, for example, Fcγ receptor-binding activity of an Fc region (enhancement of binding activity or reduction of binding activity), selectivity of an Fc region for Fcγ receptor isoform (improvement of binding activity selectivity), physicochemical stability of an Fc region, ADCC activity, and ADCP activity. Here, Fcγ receptor isoform selectivity of an Fc region means selective binding to specific isoforms of Fcγ receptor. Physicochemical stability of an Fc region means, for example, an Fc region's thermal stability, stability to protease, stability to chemical treatment, stability to freeze thawing, storage stability, stability under acidic conditions, photostability, stability to shaking- or concentration-associated stress, or maintenance of solubility in a wide range of solution conditions. Furthermore, an Fc region function may refer to a function combining two or more functions from Fcγ receptor-binding activity of an Fc region, Fcγ receptor isoform selectivity of an Fc region, and physicochemical stability of an Fc region; and this means, for example, a function combining Fcγ receptor-binding activity of an Fc region and Fcγ receptor isoform selectivity of an Fc region, a function combining Fcγ receptor-binding activity of an Fc region and physicochemical stability of an Fc region, a function combining Fcγ receptor isoform selectivity of an Fc region and physicochemical stability of the Fc region, and a function combining Fcγ receptor-binding activity of an Fc region, Fcγ receptor isoform selectivity of an Fc region, and physicochemical stability of an Fc region.

In the present invention, "alteration of Fc region function" means, for example, enhancement, reduction, or such of Fcγ receptor-binding activity of an Fc region when the Fc region function refers to the Fcγ receptor-binding activity of the Fc region. Improvement of selectivity means, for example, enhancing binding activity to an Fcγ receptor and at the same time maintaining or lowering binding activities to other Fcγ receptors. Alternatively, improvement of selectivity means, for example, lowering binding activity to certain Fcγ receptors while maintaining or enhancing binding activities to other Fcγ receptors. Furthermore, for example, when the Fc region function refers to Fcγ receptor subtype selectivity of an Fc region, "alteration of Fc region function" means improving or lowering the Fcγ receptor subtype selectivity of the Fc region. Alternatively, for example, when the Fc region function refers to physicochemical stability of an Fc region, "alteration of Fc region function" means improving or lowering the physicochemical stability of the Fc region, suppressing a decrease in stability, or such; and more specifically it means, for example, improving or lowering the Tm value of the CH2 domain, suppressing a decrease in the Tm value, or such.

For example, improvement of combined functions of Fcγ receptor-binding activity of an Fc region, Fcγ receptor isoform selectivity of an Fc region, and physicochemical stability of an Fc region does not necessarily have to be improvement in every one of the Fcγ receptor-binding activity of an Fc region, the Fcγ receptor isoform selectivity of an Fc region, and the physicochemical stability of an Fc region when compared to a control, and the improvement is acceptable as long as the Fc region function is improved as a whole. Conversely, for example, lowering of combined functions of the Fcγ receptor-binding activity of an Fc region, the Fcγ receptor isoform selectivity of an Fc region, and the physicochemical stability of an Fc region does not necessarily have to be decrease in every one of the Fcγ receptor-binding activity of an Fc region, the Fcγ receptor isoform selectivity of an Fc region, and the physicochemical stability of an Fc region when compared to a control, and the decrease is acceptable as long as the Fc region function is lowered as a whole.

In the present invention, "Fcγ receptors" (herein, referred to as Fcγ receptors, FcγR, or FcgR) refers to receptors that may bind to the Fc region of IgG1, IgG2, IgG3, and IgG4, and practically means any member of the family of proteins encoded by the Fcγ receptor genes. In humans, this family includes FcγRI (CD64) including isoforms FcγRIa, FcγRIb, and FcγRII; FcγRII (CD32) including isoforms FcγRIIa (including allotypes H131 (type H) and R131 (type R)), FcγRIIb (including FcγRIIb-1 and FcγRIIb-2), and FcγRIIc; and FcγRIII (CD16) including isoforms FcγRIIIa (including allotypes V158 and F158), and FcγRIIIb (including allotypes FcγRIIIb-NA1 and FcγRIIIb-NA2), and any human FcγRs, FcγR isoforms or allotypes yet to be discovered, but is not limited thereto. The FcγRs include human, mouse, rat, rabbit, and monkey-derived FcγRs but is not limited thereto, and may be derived from any organism. Mouse FcγRs include FcγRI (CD64), FcγRII (CD32), FcγRIII (CD16), and FcγRIII-2 (CD16-2 or FcγRIV), and any mouse FcγRs, or FcγR isoforms or allotypes yet to be discovered, but are not limited thereto. Favorable examples of such Fcγ receptors include human FcγRI (CD64), FcγRIIa (CD32), FcγRIIb (CD32), FcγRIIIa (CD16), and/or FcγRIIIb (CD16).

For FcγRs, there are activating receptors carrying the immunoreceptor tyrosine-based activation motif (ITAM) and inhibitory receptor carrying the immunoreceptor tyrosine-based inhibitory motif (ITIM). FcγRs are classified into activating FcγRs: FcγRI, FcγRIIa R, FcγRII H, FcγRIIIa, and FcγRIIIb, and inhibitory FcγR: FcγRIIb.

The polynucleotide sequence and amino acid sequence of FcγRI are set forth in NM_000566.3 and NP_000557.1, respectively;

the polynucleotide sequence and amino acid sequence of FcγRIIa are set forth in BC020823.1 and AAH20823.1, respectively;

the polynucleotide sequence and amino acid sequence of FcγRIIb are set forth in BC146678.1 and AAI46679.1, respectively;

the polynucleotide sequence and amino acid sequence of FcγRIIIa are set forth in BC033678.1 and AAH33678.1, respectively; and the polynucleotide sequence and amino acid sequence of FcγRIIIb are set forth in BC128562.1 and AAI28563.1, respectively (the RefSeq Registration number).

In FcγRIIa, there are two allotypes, one where the amino acid at position 131 of FcγRIIa is histidine (type H) and the other where this amino acid is substituted with arginine (type R) (J. Exp. Med, 172: 19-25, 1990). In FcγRIIb, there are two allotypes, one where the amino acid at position 232 of FcγRIIb is isoleucine (type I) and the other where this amino acid is substituted with threonine (type T) (Arthritis. Rheum. 46: 1242-1254 (2002)). In FcγRIIIa, there are two allotypes, one where the amino acid at position 158 of FcγRIIIa is valine (type V) and the other where this amino acid is substituted with phenylalanine (type F) (J. Clin. Invest. 100(5): 1059-1070 (1997)). Furthermore, in FcγRIIIb, there are two allotypes, the NA1 type and the NA2 type (J. Clin. Invest. 85: 1287-1295 (1990)).

One of the substances (the ligand) in observation of an interaction is immobilized onto a gold thin film on a sensor chip, and by shining light from the reverse side of the sensor chip so that total reflection takes place at the interface between the gold thin film and glass, a portion of reduced reflection intensity is formed in part of the reflected light (SPR signal). When the other one of the substances (the analyte) in observation of an interaction is made to flow on the sensor chip surface and the ligand binds to the analyte, the mass of the immobilized ligand molecule increases and the refractive index of the solvent on the sensor chip surface changes. The position of the SPR signal shifts as a result of this change in refractive index (on the other hand, the signal position returns when this binding dissociates). The Biacore system indicates the amount of shift mentioned above, or more specifically the time variable of mass by plotting the change in mass on the sensor chip surface on the ordinate as the measurement data (sensorgram). The amount of analyte bound to the ligand captured on the sensor chip surface is determined from the sensorgram (amount of change in the response on the sensorgram before and after interaction with the analyte). However, since the amount of binding also depends on the amount of ligand, it is necessary to make the comparison under conditions where the amount of ligand is considered to be practically the same. Kinetic parameters such as association rate constants (ka) and dissociation rate constants (kd) are determined from the curve of the sensorgram, and the affinities (KD) are determined from the ratio of these constants. In the BIACORE method, a method for measuring inhibition is preferably used. An example of the method for measuring inhibition is described in Proc. Natl. Acad. Sci USA (2006) 103 (11), 4005-4010.

In the present invention, whether or not the binding activity towards each type of Fcγ receptor is enhanced or decreased in a polypeptide or in an Fc region of the present invention can be determined, for example, by using Biacore (GE Healthcare) which is an interaction analyzer that utilizes the surface plasmon resonance (SPR) phenomena, as shown in the Examples. Biacore includes any models such as Biacore T100, T200, X100, A100, 4000, 3000, 2000, 1000, and C. For the sensor chip, any sensorchips for Biacore such as CM7, CM5, CM4, CM3, C1, SA, NTA, L1, HPA, and Au chip can be used. For the running buffer, besides HBE-EP+, a buffer produced by using HEPES, phosphoric acid, ACES, Tris, citric acid, and such to adjust the pH to a near neutral pH such as 7.4 can be used. The measurements can be performed in the range of 4° C. to 37° C. A protein for capturing antibodies such as Protein A, Protein G, or Protein L, which captures an antibody, anti-human IgG antibody, anti-human IgG-Fab, anti-human L chain antibody, anti-human Fc antibody, antigen protein, or antigen peptide is immobilized onto a sensor chip by coupling methods such as amine coupling, disulfide coupling, or aldehyde coupling. Various types of Fcγ receptors such as Fcγ receptor I, IIa R type, IIa H type, IIb, IIIc F type, V type, and IIIb are applied as analytes, and interactions were measured to obtain sensorgrams. At this point, measurements can be carried out by adjusting the Fcγ receptor concentration to a level in the range of several μM to several pM according to the strength of interaction such as KD of the sample to be measured. The dissociation constant (KD) is obtained based on the measurement, and by observing whether the KD value is decreased or increased, one can determine whether the binding activity of an Fc region or a polypeptide of the present invention to various Fcγ receptors is increased or decreased. When capturing is carried out by the antibody-capturing protein immobilized onto the sensor chip, the level of change in the sensorgram values before and after applying various Fcγ receptors as analytes for the antibodies on the sensor chip is used as an indicator; and according to the degree of the value increase, one can determine whether the binding activity of the polypeptide or Fc region of the present invention to various Fcγ receptors is increased or decreased. Alternatively, it is also possible to immobilize various Fcγ receptors, instead of antibodies, onto the sensor chips, and make them interact with an antibody sample to be evaluated. Whether the binding activity of the Fc region or the polypeptide of the present invention to the various Fcγ receptors is enhanced or decreased can be determined from the decrease or increase in KD values calculated from the interaction sensorgrams, or from the degree of increase in the sensorgrams before and after allowing the antibody sample to react.

Specifically, the binding activity of an Fc region towards an Fcγ receptor can be measured by the Amplified Luminescent Proximity Homogeneous Assay (ALPHA) screening, the BIACORE method which utilizes the surface plasmon resonance (SPR) phenomena, or such, in addition to ELISA or fluorescence activated cell sorting (FACS) (Proc. Natl. Acad. Sci. USA (2006) 103 (11): 4005-4010).

ALPHA screening is performed by ALPHA technology which uses two beads, a donor and an acceptor, based on the following principles. Luminescent signals are detected only when molecules bound to donor beads physically interact with molecules bound to the acceptor beads, and the two beads are in close proximity to each other. Laser-excited photosensitizer in the donor beads converts ambient oxygen to excited-state singlet oxygen. Singlet oxygen is dispersed around the donor beads, and when it reaches the adjacent acceptor beads, chemiluminescent reaction is induced in the beads, and light is ultimately emitted. When the molecules bound to the donor beads do not interact with the molecules bound to the acceptor beads, the chemiluminescent reaction does not take place because singlet oxygen produced by the donor beads does not reach the acceptor beads.

For example, a biotinylated test polypeptide is bound to streptavidin on the donor beads, and Fcγ receptor tagged with glutathione S transferase (GST) is linked to the acceptor beads. In the absence of a competing polypeptide, the test polypeptide interacts with the Fcγ receptor and produces 520-620 nm signals. An untagged polypeptide competes with the test polypeptide for interaction with the Fcγ receptor. Relative binding activities can be determined by quantifying the decrease in fluorescence observed as a result of the competition. Biotinylation of polypeptide using Sulfo-NHS-biotin and such is well known. The method of expressing the Fcγ receptor and GST in a cell carrying a fusion gene produced by fusing a polynucleotide encoding the Fcγ receptor in frame with a polynucleotide encoding GST in an expressible vector, and performing purification using a glutathione column is appropriately adopted as a method for tagging an Fcγ receptor with GST. The obtained signals are preferably analyzed, for example, by fitting them to a one-site competition model which uses a non-linear regression analysis using software such as GRAPHPAD PRISM (GraphPad, San Diego).

Tagging is not limited to the use of GST, and any tag such as histidine tag, MBP, CBP, Flag tag, HA tag, V5 tag, and c-myc tag, may be used. Furthermore, the binding of a test polypeptide to donor beads is not limited to binding using the biotin-streptavidin reaction. In particular, when a test polypeptide is an antibody or peptide carrying Fc such as an Fc fusion polypeptide, a method of binding a test polypeptide through an Fc-recognizing protein such as Protein A or Protein G on the donor beads can be considered.

Reduction of binding to FcγR or FcγR-binding activity refers to binding to FcγR with a substantially weaker binding activity than that of the parent polypeptide when assays are performed using practically the same amount of polypeptides to be compared.

Heterodimerized polypeptides with attenuated, decreased, or lowered binding to FcγR or FcγR-binding activity refers to those that bind to FcγR with a substantially weaker binding activity than that of homodimerized polypeptides when assays are performed using practically the same amount of polypeptides to be compared.

For example, in the KD values measured by the above-mentioned measurement methods, the KD value ratio (KD value of the parent polypeptide/KD value of the mutated polypeptide) is preferably 0.99 or less, 0.95 or less, 0.9 or less, 0.8 or less, 0.7 or less, 0.5 or less, 0.3 or less, and 0.1 or less, and more preferably, 0.08 or less, 0.05 or less, 0.02 or less, 0.01 or less, and 0.001 or less. Herein, the KD value ratio is also called the KD ratio.

The KD values measured by the above-mentioned measurement methods are preferably increased by 1 pM or more, and more preferably increased by 10 pM, 100 pM, 1 nM or more, 2 nM or more, 3 nM or more, 5 nM or more, 10 nM or more, 20 nM or more, 50 nM or more, 100 nM or more, or 1 µM or more. The KD values measured by the above-mentioned measurement methods are preferably 1 pM or more, and preferably 10 pM or more, 100 pM or more, 1 nM or more, 10 nM or more, 100 nM or more, 500 nM or more, 1 µM or more, 3 µM or more, or 5 µM or more.

Enhancement, increase, or improvement of binding to FcγR or FcγR-binding activity refers to binding to FcγR with a substantially stronger binding activity than that of the parent polypeptide when assays are performed using practically the same amount of polypeptides to be compared.

Heterodimerized polypeptides with enhanced, increased, or improved binding to FcγR or FcγR-binding activity refers to those that bind to FcγR with a substantially stronger binding activity than that of homodimerized polypeptides when assays are performed using practically the same amount of polypeptides to be compared.

For example, in the KD values measured by the above-mentioned measurement methods, the KD value ratio (KD value of the parent polypeptide/KD value of the mutated polypeptide) is preferably 1.1 or more, 1.2 or more, 1.3 or more, 1.5 or more, 1.8 or more, 2 or more, or 3 or more, and more preferably, 5 or more, 10 or more, 100 or more, 250 or more, or 1000 or more. Herein, the KD value ratio is also called KD ratio.

The KD values measured by the above-mentioned measurement methods are preferably decreased by 1 pM or more, and more preferably decreased by 10 pM, 100 pM, 1 nM or more, 2 nM or more, 3 nM or more, 5 nM or more, 10 nM or more, 20 nM or more, 50 nM or more, 100 nM or more, or 1 µM or more.

The KD values measured by the above-mentioned measurement methods are preferably 5 µM or less, and more preferably, 3 µM or less, 1 µM or less, 0.5 µM or less, 0.1 µM or less, 0.01 µM or less, 1 nM or less, 0.1 nM or less, 0.001 nM or less, or 1 pM or less.

In the present invention, when alteration of Fc region function of the polypeptide is enhancement of binding activity to an Fcγ receptor, amino acid mutations may be introduced into the amino acid sequences of the first polypeptide and/or the second polypeptide constituting the aforementioned Fc region. The type and range of the amino acid mutation to be introduced are not particularly limited.

The strength of interaction between an antibody Fc region and FcγR has been reported to depend on the $Zn^{2+}$ ion concentration (Immunology Letters 143 (2012) 60-69). The antibody shows a stronger interaction between the Fc region and FcgR when the $Zn^{2+}$ ion concentration of the Fc region is higher. Chelation of $Zn^{2+}$ by His310 and His435 present in CH3 of the antibody Fc region opens up each CH2 domain of the Fc region at a distal position. This facilitates interaction between the CH2 domain and FcgR, and the interaction between the Fc region and FcgR is enhanced. A non-limiting embodiment of the antibody of the present invention includes an Fc region in which His at position 310, His at position 435, His at position 433, and/or Asn at position 434 (EU numbering) is chelated with $Zn^{2+}$.

When the Fcγ receptor is FcγRIa, at least one or more amino acid mutations selected from the group consisting of the amino acid mutations described in Region i of Tables 2-1 and 2-2 herein may be introduced into the amino acid sequences of the first polypeptide and/or the second polypeptide constituting the Fc region. Furthermore, when the Fcγ receptor is FcγRIa, at least one or more amino acid mutations selected from the group consisting of the amino acid mutations described in Region ii of Tables 2-1, 2-2, and 2-3 herein may be introduced into the amino acid sequences of the first polypeptide and/or the second polypeptide constituting the Fc region.

When the Fcγ receptor is FcγRIIa R, at least one or more amino acid mutations selected from the group consisting of the amino acid mutations described in Region i of Tables 3-1 and 3-2 herein may be introduced into the amino acid sequences of the first polypeptide and/or the second polypeptide constituting the Fc region. Furthermore, when the Fcγ receptor is FcγRIIa R, at least one or more amino acid mutations selected from the group consisting of the amino acid mutations described in Region ii of Tables 3-1 and 3-2 herein may be introduced into the amino acid sequences of the first polypeptide and/or the second polypeptide constituting the Fc region.

When the Fcγ receptor is FcγRIIa H, at least one or more amino acid mutations selected from the group consisting of the amino acid mutations described in Region i of Table 4 herein may be introduced into the amino acid sequences of the first polypeptide and/or the second polypeptide constituting the Fc region. Furthermore, when the Fcγ receptor is FcγRIIa H, at least one or more amino acid mutations selected from the group consisting of the amino acid mutations described in Region ii of Table 4 herein may be introduced into the amino acid sequences of the first polypeptide and/or the second polypeptide constituting the Fc region.

When the Fcγ receptor is FcγRIIb, at least one or more amino acid mutations selected from the group consisting of the amino acid mutations described in Region i of Table 5 herein may be introduced into the amino acid sequences of the first polypeptide and/or the second polypeptide constituting the Fc region. Furthermore, when the Fcγ receptor is FcγRIIb, at least one or more amino acid mutations selected from the group consisting of the amino acid mutations described in Region ii of Table 5 herein may be introduced into the amino acid sequences of the first polypeptide and/or the second polypeptide constituting the Fc region.

When the Fcγ receptor is FcγRIIIa, at least one or more amino acid mutations selected from the group consisting of the amino acid mutations described in Region i of Table 6 herein may be introduced into the amino acid sequences of the first polypeptide and/or the second polypeptide constituting the Fc region. Furthermore, when the Fcγ receptor is FcγRIIIa, at least one or more amino acid mutations selected from the group consisting of the amino acid mutations described in Region ii of Table 6 herein may be introduced into the amino acid sequences of the first polypeptide and/or the second polypeptide constituting the Fc region. Furthermore, when the Fcγ receptor is FcγRIIIa, more specifically, at least one or more (for example, two or three) amino acid mutations selected from the group consisting of substitution of amino acid L at position 234 (EU numbering) with Y; substitution of amino acid L at position 235 (EU numbering) with Y or Q; substitution of amino acid G at position 236 (EU numbering) with W; substitution of amino acid S at position 239 (EU numbering) with M; substitution of amino acid H at position 268 (EU numbering) with D; substitution of amino acid D at position 270 (EU numbering) with E; substitution of amino acid S at position 298 (EU numbering)

with A; substitution of amino acid K at position 326 (EU numbering) with D; substitution of amino acid A at position 327 (EU numbering) with D; substitution of amino acid L at position 328 (EU numbering) with W; substitution of amino acid A at position 330 (EU numbering) with M or K; and substitution of amino acid K at position 334 (EU numbering) with E or L may be introduced into the amino acid sequences of the first polypeptide and/or the second polypeptide constituting the Fc region. Even more specifically, when the Fcγ receptor is FcγRIIIa, at least one or more (for example, two or three) amino acid mutations selected from the group consisting of substitution of amino acid S at position 239 (EU numbering) with D; substitution of amino acid A at position 330 (EU numbering) with L; and substitution of amino acid I at position 332 (EU numbering) with E may be introduced into the amino acid sequence of either one of the polypeptides constituting the Fc region, the first polypeptide or the second polypeptide, and at least one or more (for example, two or three) amino acid mutations selected from the group consisting of substitution of amino acid L at position 234 (EU numbering) with Y; substitution of amino acid G at position 236 (EU numbering) with W; and substitution of amino acid S at position 298 (EU numbering) with A may be introduced into the amino acid sequence of the other polypeptide.

Even more specifically, when the Fcγ receptor is FcγRIIIa, a mutation may be introduced into at least one or more (for example, two or three) amino acids selected from among Leu at position 234, Leu at position 235, Gly at position 236, Ser at position 239, His at position 268, Asp at position 270, Ser at position 298, Ala at position 327, Leu at position 328, and Lys at position 334 (EU numbering) in the amino acid sequence of either one of the polypeptides constituting the Fc region, the first polypeptide or the second polypeptide; and a mutation may be introduced into at least one or more (for example, two or three) amino acids selected from among Asp at position 270, Lys at position 326, Ala at position 330, and Lys at position 334 (EU numbering) in the amino acid sequence of the other polypeptide.

The amino acid to be altered may be selected appropriately, and preferably at least one or more (for example, two or three) amino acid mutations selected from the group consisting of:
substitution of amino acid L at position 234 (EU numbering) with Y;
substitution of amino acid L at position 235 (EU numbering) with Y or Q;
substitution of amino acid G at position 236 (EU numbering) with W;
substitution of amino acid S at position 239 (EU numbering) with M;
substitution of amino acid H at position 268 (EU numbering) with D;
substitution of amino acid D at position 270 (EU numbering) with E;
substitution of amino acid S at position 298 (EU numbering) with A;
substitution of amino acid A at position 327 (EU numbering) with D;
substitution of amino acid L at position 328 (EU numbering) with W; and
substitution of amino acid K at position 334 (EU numbering) with L may be introduced into the amino acid sequence of either one of the polypeptides constituting the Fc region, the first polypeptide or the second polypeptide; and at least one or more (for example, two or three) amino acid mutations selected from the group consisting of:
substitution of amino acid D at position 270 (EU numbering) with E;
substitution of amino acid K at position 326 (EU numbering) with D;
substitution of amino acid A at position 330 (EU numbering) with M or K; and
substitution of amino acid K at position 334 (EU numbering) with E may be introduced into the amino acid sequence of the other polypeptide.

More preferably, any one set of mutations of (i) to (vi) may be introduced into the amino acid sequence of either one of the polypeptides constituting the Fc region, the first polypeptide or the second polypeptide; and any one set of mutations of (vii) to (ix) may be introduced into the amino acid sequence of the other polypeptide:

(i) substitution of amino acid L at position 234 (EU numbering) with Y;
   substitution of amino acid L at position 235 (EU numbering) with Y;
   substitution of amino acid G at position 236 (EU numbering) with W;
   substitution of amino acid H at position 268 (EU numbering) with D; and
   substitution of amino acid S at position 298 (EU numbering) with A;

(ii) substitution of amino acid L at position 234 (EU numbering) with Y;
   substitution of amino acid L at position 235 (EU numbering) with Y;
   substitution of amino acid G at position 236 (EU numbering) with W;
   substitution of amino acid H at position 268 (EU numbering) with D;
   substitution of amino acid D at position 270 (EU numbering) with E; and
   substitution of amino acid S at position 298 (EU numbering) with A;

(iii) substitution of amino acid L at position 234 (EU numbering) with Y;
   substitution of amino acid L at position 235 (EU numbering) with Q;
   substitution of amino acid G at position 236 (EU numbering) with W;
   substitution of amino acid S at position 239 (EU numbering) with M;
   substitution of amino acid H at position 268 (EU numbering) with D;
   substitution of amino acid D at position 270 (EU numbering) with E; and
   substitution of amino acid S at position 298 (EU numbering) with A;

(iv) substitution of amino acid L at position 234 (EU numbering) with Y;
   substitution of amino acid L at position 235 (EU numbering) with Y;
   substitution of amino acid G at position 236 (EU numbering) with W;
   substitution of amino acid H at position 268 (EU numbering) with D;
   substitution of amino acid S at position 298 (EU numbering) with A; and
   substitution of amino acid A at position 327 (EU numbering) with D;

(v) substitution of amino acid L at position 234 (EU numbering) with Y;
   substitution of amino acid L at position 235 (EU numbering) with Y;

substitution of amino acid G at position 236 (EU numbering) with W;
substitution of amino acid S at position 239 (EU numbering) with M;
substitution of amino acid H at position 268 (EU numbering) with D;
substitution of amino acid S at position 298 (EU numbering) with A; and
substitution of amino acid A at position 327 (EU numbering) with D;
(vi) substitution of amino acid L at position 234 (EU numbering) with Y;
substitution of amino acid L at position 235 (EU numbering) with Y;
substitution of amino acid G at position 236 (EU numbering) with W;
substitution of amino acid S at position 239 (EU numbering) with M;
substitution of amino acid H at position 268 (EU numbering) with D;
substitution of amino acid S at position 298 (EU numbering) with A;
substitution of amino acid A at position 327 (EU numbering) with D;
substitution of amino acid L at position 328 (EU numbering) with W; and
substitution of amino acid K at position 334 (EU numbering) with L;
(vii) substitution of amino acid K at position 326 (EU numbering) with D;
substitution of amino acid A at position 330 (EU numbering) with M; and
substitution of amino acid K at position 334 (EU numbering) with E;
(viii) substitution of amino acid D at position 270 (EU numbering) with E;
substitution of amino acid K at position 326 (EU numbering) with D;
substitution of amino acid A at position 330 (EU numbering) with M; and
substitution of amino acid K at position 334 (EU numbering) with E;
(ix) substitution of amino acid D at position 270 (EU numbering) with E;
substitution of amino acid K at position 326 (EU numbering) with D;
substitution of amino acid A at position 330 (EU numbering) with K; and
substitution of amino acid K at position 334 (EU numbering) with E.

Heterodimers that are good for enhancing binding to activating Fcγ receptors and for inducing effector functions are polypeptides characterized in being composed of a heterodimer comprising a first polypeptide and a second polypeptide, wherein either the first polypeptide or the second polypeptide may comprise an Fc region introduced with the mutations of (i) or (ii):

(i) according to EU numbering, the amino acid at position 234 is L, S, F, E, V, D, Q, I, M, T, A, G, or H; the amino acid at position 235 is Y or Q; the amino acid at position 236 is W; the amino acid at position 239 is M or I; the amino acid at position 268 is D; and the amino acid at position 298 is A; or (ii) according to EU numbering, the amino acid at position 270 is E; the amino acid at position 326 is D; the amino acid at position 330 is A, K, M, F, I, Y, or H; and the amino acid at position 334 is E.

More specifically, in either the first polypeptide or the second polypeptide, the mutations of (iii) or (iv) may be introduced into the Fc region, and in the other polypeptide, the mutations of (v) may be introduced into the Fc region:

(iii) according to EU numbering, the amino acid at position 234 is L, S, F, E, V, D, Q, I, M, T, A, G, or H; the amino acid at position 235 is Y or Q; the amino acid at position 236 is W; the amino acid at position 239 is M or I; the amino acid at position 268 is D; the amino acid at position 298 is A; and the amino acid at position 327 is D; or (iv) according to EU numbering, the amino acid at position 234 is L, S, F, E, V, D, Q, I, M, T, A, G, or H; the amino acid at position 235 is Y or Q; the amino acid at position 236 is W; the amino acid at position 239 is M or I; the amino acid at position 268 is D; the amino acid at position 270 is E; and the amino acid at position 298 is A;

(v) according to EU numbering, the amino acid at position 270 is E; the amino acid at position 326 is D; the amino acid at position 330 is A, K, M, F, I, Y, or H; and the amino acid at position 334 is E.

Specifically, to enhance the binding activity towards Fcγ receptor IIIa, in either the first polypeptide or the second polypeptide, the amino acid at position 234 according to EU numbering in (iii) mentioned above is preferably E, D, T, or L. Furthermore, to enhance the binding activity towards Fcγ receptor IIIa and to lower the binding activity towards Fcγ receptor TM, the amino acid at position 234 according to EU numbering in (iv) mentioned above is more preferably L, F, E, or D.

To enhance the binding activity towards Fcγ receptor IIa, in either the first polypeptide or the second polypeptide, the amino acid at position 234 according to EU numbering in (iii) mentioned above is preferably V, I, T, M, or L. Among them, I, T, or L is preferred; and in this case, it may also be possible to increase the binding activity towards Fcγ receptor IIIa.

Heterodimers which enhance binding to activating Fcγ receptors and are good at inducing effector functions are preferably heterodimers where:

in either the first polypeptide or the second polypeptide, according to EU numbering, the amino acid at position 234 is V, E, D, T, I, L, or F, and the amino acid at position 239 is M or I in (iii) mentioned above, and in the other polypeptide, the amino acid at position 330 according to EU numbering is A or K in (v) mentioned above; or in either the first polypeptide or the second polypeptide, according to EU numbering, the amino acid at position 234 is F, E, D, S, or L, and the amino acid at position 239 is M or I in (iv) mentioned above, and in the other polypeptide, the amino acid at position 330 according to EU numbering is A, F, or K in (v) mentioned above.

More specifically, examples include combinations of amino acid mutations introduced as described in the Examples.

Selectivity of binding activity can be determined by measuring the binding activities of the polypeptide towards the respective Fcγ receptor isoforms, and then determining their ratios. For example, the amount of binding and KD value towards an FcγR can be used as an indicator of binding activity.

Herein, "improvement of selectivity of binding activity" means that, for example, the ratio of binding activities of a test polypeptide to Fcγ receptor isoforms (binding activity of the test polypeptide to a first Fcγ receptor isoform/binding activity of the test polypeptide to the second Fcγ receptor isoform) is increased by 0.1 or more, or preferably 0.2 or more, 0.5 or more, 1 or more, 2 or more, 3 or more, 5 or more, 7 or more, 8 or more, 9 or more, 10 or more, 15 or more, 20 or more, 30 or more, 50 or more, 70 or more, 100 or more, 150 or more, 200 or more, 500 or more, or 1000 or more when compared to the ratio of binding activities of a parent polypeptide of the test polypeptide to the Fcγ receptor isoforms (binding activity of the parent polypeptide of the test polypeptide to the first Fcγ receptor isoform/binding activity of the parent polypeptide of the test polypeptide to the second Fcγ receptor isoform) determined based on the above-mentioned measurement method. Furthermore, decreased Fcγ receptor isoform selectivity means that, for example, the ratio of binding activities of a test polypeptide to Fcγ receptor isoforms is reduced by 0.1 or more, or preferably 0.2 or more, 0.5 or more, 1 or more, 2 or more, 3 or more, 5 or more, 7 or more, 8 or more, 9 or more, 10 or more, 15 or more, 20 or more, 30 or more, 50 or more, 70 or more, 100 or more, 150 or more, 200 or more, 500 or more, or 1000 or more when compared to the ratio of binding activities of the parent peptide of the test polypeptide to the Fcγ receptor isoforms determined based on the above-mentioned measurement method.

Herein, as an indicator of selectivity, for example, the A/I ratio which shows the ratio of binding activities towards activating FcγR and inhibitory FcγR can also be used. The values obtained by dividing the KD of the test polypeptide for FcγRIIb by the KD of the test polypeptide for FcγRIIa H type or R type were used as the respective A/I ratios. The A/I ratio is preferably 1.1 or more, 1.5 or more, 2 or more, 3 or more, or 5 or more, and more preferably 6 or more, 8 or more, or 9 or more.

Herein, as an indicator of selectivity, for example, the FcγRIIIa F/FcγRIIb ratio which is a value obtained by dividing the KD for FcγRIIb by the KD for FcγRIIIa F can be used. The values obtained by dividing the KD of the test polypeptide for FcγRIIb by the KD of the test polypeptide for FcγRIIIa were defined as the respective FcγRIIIa F/FcγRIIb ratios. The FcγRIIIa F/FcγRIIb ratio is preferably 1.1 or more, 1.5 or more, 2 or more, 3 or more, or 5 or more, and more preferably 10 or more, 20 or more, 30 or more, 40 or more, 50 or more, 60 or more, 70 or more, 80 or more, 90 or more, 100 or more, 110 or more, 120 or more, 130 or more, 140 or more, 150 or more, 200 or more, 210 or more, 220 or more, 230 or more, or 240 or more.

In the present invention, when the alteration of Fc region function of the polypeptide is the improvement of selectivity of binding activity to an Fcγ receptor, an amino acid mutation may be introduced into the amino acid sequence of the first polypeptide and/or the second polypeptide constituting the Fc region. The type and range of the amino acid mutation to be introduced is not particularly limited.

In a case where the activating Fcγ receptor is FcγRIa, the inhibitory Fcγ receptor is FcγRIIb, and the improvement of selectivity is selective enhancement of binding activity to FcγRIa than to FcγRIIb, at least one or more amino acid mutations selected from the group consisting of the amino acid mutations described in Region a of Tables 19-1, 19-2, 19-3, and 19-4 herein may be introduced into the amino acid sequences of the first polypeptide and/or the second polypeptide constituting the Fc region. Furthermore, when the improvement of selectivity is selective enhancement of binding activity to FcγRIa than to FcγRIIb, at least one or more amino acid mutations selected from the group consisting of the amino acid mutations described in Region b of Tables 19-1, 19-2, 19-3, 19-4, and 19-5 herein may be introduced into the amino acid sequences of the first polypeptide and/or the second polypeptide constituting the Fc region.

In a case where the activating Fcγ receptor is FcγRIa, the inhibitory Fcγ receptor is FcγRIIb, and the improvement of selectivity is selective reduction of binding activity to FcγRIa than to FcγRIIb, at least one or more amino acid mutations selected from the group consisting of the amino acid mutations described in Region c of Tables 23-1 and 23-2 herein may be introduced into the amino acid sequences of the first polypeptide and/or the second polypeptide constituting the Fc region. Furthermore, when the improvement of selectivity is selective reduction of binding activity to FcγRIa than to FcγRIIb, at least one or more amino acid mutations selected from the group consisting of the amino acid mutations described in Region d of Tables 23-1 and 23-2 herein may be introduced into the amino acid sequences of the first polypeptide and/or the second polypeptide constituting the Fc region.

In a case where the activating Fcγ receptor is FcγRIIa R, the inhibitory Fcγ receptor is FcγRIIb, and the improvement of selectivity is selective enhancement of binding activity to FcγRIIa R than to FcγRIIb, at least one or more amino acid mutations selected from the group consisting of the amino acid mutations described in Region a of Table 20-1 herein may be introduced into the amino acid sequences of the first polypeptide and/or the second polypeptide constituting the Fc region. Furthermore, when the improvement of selectivity is selective enhancement of binding activity to FcγRIIa R than to FcγRIIb, at least one or more amino acid mutations selected from the group consisting of the amino acid mutations described in Region b of Tables 20-1, 20-2, and 20-3 herein may be introduced into the amino acid sequences of the first polypeptide and/or the second polypeptide constituting the Fc region.

In a case where the activating Fcγ receptor is FcγRIIa R, the inhibitory Fcγ receptor is FcγRIIb, and the improvement of selectivity is selective reduction of binding activity to FcγRIIa R than to FcγRIIb, at least one amino acid mutations selected from the group consisting of the amino acid mutations described in Region c of Table 24-1 herein may be introduced into the amino acid sequences of the first polypeptide and/or the second polypeptide constituting the Fc region. Furthermore, when the improvement of selectivity is selective reduction of binding activity to FcγRIIa R than to FcγRIIb, at least one or more amino acid mutations selected from the group consisting of the amino acid mutations described in Region d of Tables 24-1 and 24-2 herein may be introduced into the amino acid sequences of the first polypeptide and/or the second polypeptide constituting the Fc region.

In a case where the activating Fcγ receptor is FcγRIIa H, the inhibitory Fcγ receptor is FcγRIIb, and the improvement of selectivity is selective enhancement of binding activity to FcγRIIa H than to FcγRIIb, at least one or more amino acid mutations selected from the group consisting of the amino acid mutations described in Region a of Table 21-1 herein may be introduced into the amino acid sequences of the first polypeptide and/or the second polypeptide constituting the Fc region. Furthermore, when the improvement of selectivity is selective enhancement of binding activity to FcγRIIa H than to FcγRIIb, at least one or more amino acid mutations selected from the group consisting of the amino acid mutations described in Region b of Tables 21-1, 21-2, and 21-3 herein may be introduced into the amino acid sequences of the first polypeptide and/or the second polypeptide constituting the Fc region.

In a case where the activating Fcγ receptor is FcγRIIa H, the inhibitory Fcγ receptor is FcγRIIb, and the improvement of selectivity is selective reduction of binding activity to FcγRIIa H than to FcγRIIb, at least one or more amino acid mutations selected from the group consisting of the amino acid mutations described in Region c of Tables 25-1 and 25-2 herein may be introduced into the amino acid sequences of the first polypeptide and/or the second polypeptide constituting the Fc region. Furthermore, when the improvement of selectivity is selective reduction of binding activity to FcγRIIa H than to FcγRIIb, at least one or more amino acid mutations selected from the group consisting of the amino acid mutations described in Region d of Tables 25-1, 25-2, and 25-3 herein may be introduced into the amino acid sequences of the first polypeptide and/or the second polypeptide constituting the Fc region.

In a case where the activating Fcγ receptor is FcγRIIIa, the inhibitory Fcγ receptor is FcγRIIb, and the improvement of selectivity is selective enhancement of binding activity to FcγRIIIa than to FcγRIIb, at least one or more amino acid mutations selected from the group consisting of the amino acid mutations described in Region a of Table 22-1 herein may be introduced into the amino acid sequences of the first polypeptide and/or the second polypeptide constituting the Fc region. Furthermore, when the improvement of selectivity is selective enhancement of binding activity to FcγRIIIa than to FcγRIIb, at least one or more amino acid mutations selected from the group consisting of the amino acid mutations described in Region b of Tables 22-1, 22-2, and 22-3 herein may be introduced into the amino acid sequences of the first polypeptide and/or the second polypeptide constituting the Fc region.

In a case where the activating Fcγ receptor is FcγRIIIa, the inhibitory Fcγ receptor is FcγRIIb, and the improvement of selectivity is selective reduction of binding activity to FcγRIIIa than to FcγRIIb, at least one or more amino acid mutations selected from the group consisting of the amino acid mutations described in Region c of Tables 26-1 and 26-2 herein may be introduced into the amino acid sequences of the first polypeptide and/or the second polypeptide constituting the Fc region. Furthermore, when the improvement of selectivity is selective reduction of binding activity to FcγRIIIa than to FcγRIIb, at least one or more amino acid mutations selected from the group consisting of the amino acid mutations described in Region d of Tables 26-1, 26-2, 26-3, and 26-4 herein may be introduced into the amino acid sequences of the first polypeptide and/or the second polypeptide constituting the Fc region.

Herein, the selective enhancement of binding activity to a desired Fcγ receptor means any of the following cases:
(i) binding activity to a desired Fcγ receptor is enhanced, and binding activities to receptors other than the desired Fcγ receptor are unchanged or decreased;
(ii) binding activity to a desired Fcγ receptor is enhanced, and binding activities to receptors other than the desired Fcγ receptor are also enhanced, but the degree of enhancement of binding activity to receptors other than the desired Fcγ receptor is less than the degree of enhancement of binding activity to the desired Fcγ receptor; or
(iii) binding activity to a desired Fcγ receptor is decreased, but the degree of reduction of binding activity is less than the degree of reduction of binding activities to Fcγ receptors other than the desired Fcγ receptor.

Furthermore, selective reduction of binding activity to a desired Fcγ receptor means any of the following cases:
(i) binding activity to a desired Fcγ receptor is decreased, and binding activities to receptors other than the desired Fcγ receptor are unchanged or enhanced;
(ii) binding activity to a desired Fcγ receptor is decreased, and binding activities to receptors other than the desired Fcγ receptor are also decreased, but the degree of reduction of binding activity to receptors other than the desired Fcγ receptor is less than the degree of reduction of binding activity to the desired Fcγ receptor; or
(iii) binding activity to a desired Fcγ receptor is enhanced, but the degree of enhancement of binding activity is less than the degree of enhancement of binding activities to Fcγ receptors other than the desired Fcγ receptor.

Herein, physicochemical stability of a polypeptide means, for example, thermodynamic stability of a polypeptide, which can be determined using, for example, the Tm value of the CH2 domain as an indicator. Tm values can be measured by circular dichroism (CD), differential scanning calorimeter (DSC), or differential scanning fluorimetry (DSF).

The change in mean residue molar ellipticity (θ) that accompanies a rise in temperature is measured by CD to calculate the Tm value. The measuring instrument includes, for example, a circular dichroism dispersion meter (JASCO Corporation). When CD spectra are measured at a suitable wavelength (for example, 208 nm or 222 nm) while increasing the temperature, increases at a certain temperature, and becomes a constant value at higher temperatures. The temperature at which a midpoint value between low-temperature θ and high-temperature θ is taken as Tm. For measurement, it is possible to use, for example, a protein solution prepared using citric acid, Tris, phosphate solution, or such, at a concentration of several hundred μg/mL.

DSC measures the change in calorie that accompanies a rise in temperature to calculate the Tm value. The measuring instrument includes MicroCal VP-DSC and Micro Cal Capillary DSC (both from DKSH Japan). A protein solution and a buffer are filled in measurement cells, and when temperature differences among the cells are measured while raising the temperature, a change to endothermic reaction is observed starting at a certain temperature. This temperature is taken to be Tm. For measurement, it is possible to use, for example, a protein solution prepared using citrate buffer, TBS, PBS, histidine buffer, or such at a concentration of several ten μg/mL to several hundred μg/mL.

DSF detects exposure of hydrophobic residues that accompanies a rise in temperature by using a fluorescent reagent (for example, SYPRO Orange) that specifically binds to hydrophobic residues to calculate the Tm value. A protein solution and a fluorescence reagent are mixed at appropriate ratios, and when fluorescence intensities are measured while raising the temperature using an RT-PCR instrument, increase in fluorescence intensity is observed at a certain temperature. This temperature is taken to be Tm. Examples of the measuring instrument include Rotor-Gene Q (QIAGEN), and CFX96 real-time PCR analysis system (Bio-Rad). For measurement, it is possible to use, for example, a protein solution prepared using PBS, histidine buffer, or such at a concentration of several ten μg/mL to several hundred μg/mL.

Herein, improved physicochemical stability of a polypeptide means that, for example, the Tm value of the CH2 domain in the Fc region of a test polypeptide determined based on the above-mentioned measurement method is increased by 0.1 degrees or more, preferably 0.2 degrees or more, 0.3 degrees or more, 0.4 degrees or more, 0.5 degrees or more, 1 degree or more, 2 degrees or more, 3 degrees or more, 4 degrees or more, 5 degrees or more, or 10 degrees or more compared to the Tm value of the CH2 domain in the Fc region of a control polypeptide. Furthermore, improved physical stability of a polypeptide refers to suppressed reduction of physical stability of a polypeptide; and for example, reduction of the Tm value of the CH2 domain in the Fc region of a test polypeptide is suppressed relative to the Tm value of the CH2 domain in the Fc region of a control polypeptide by 0.1 degrees or more, preferably 0.2 degrees or more, 0.3 degrees or more, 0.4 degrees or more, 0.5 degrees or more, 1 degree or more, 2 degrees or more, 3 degrees or more, 4 degrees or more, 5 degrees or more, or 10 degrees or more, as determined based on the above-mentioned measurement method.

Herein, "reduction of physical stability of a polypeptide" means that the Tm value of the CH2 domain in the Fc region of a test polypeptide determined based on the above-mentioned measurement method is decreased by 0.1 degrees or more, preferably 0.2 degrees or more, 0.3 degrees or more, 0.4 degrees or more, 0.5 degrees or more, 1 degree or more, 2 degrees or more, 3 degrees or more, 4 degrees or more, 5 degrees or more, or 10 degrees or more compared to the Tm value of CH2 domain in the Fc region of a control peptide.

Furthermore, the present invention includes polypeptides characterized in being composed of a heterodimer comprising a first polypeptide and a second polypeptide, wherein the first polypeptide and the second polypeptide comprise an Fc region introduced with mutations, wherein the function of the Fc region is altered compared to a polypeptide comprising an Fc region without introduction of mutations.

In the polypeptide, the alteration of Fc region function may be an alteration that further improves physicochemical stability, in addition to at least one or more alterations selected from the group consisting of enhancement of binding activity, reduction of binding, and improvement of selectivity of binding activity of the polypeptide to an Fcγ receptor; and as long as any of these functions is altered, it can be said that the Fc region function of the present invention is altered.

In the present invention, the phrase "when amino acid mutations are introduced into the Fc region in both the first polypeptide and the second polypeptide, the Fc region function is not altered" means that when the same amino acid mutations are introduced into both the first polypeptide and the second polypeptide, the desired function is not improved. For example, it means that when one intends to enhance the binding activity of a polypeptide to an Fcγ receptor, the binding activity does not change or is decreased; when one intends to reduce the binding activity, the binding activity does not change or is enhanced; when one intends to improve selectivity of the binding activity, the selectivity is not improved; and when one intends to improve physicochemical stability of the polypeptide, the stability does not change or is decreased. Regarding the amino acid mutation, the phrase "when it is introduced into only one of the Fc regions, the Fc region function is altered" means that the desired function is improved when the amino acid mutation is introduced only into either the first polypeptide or the second polypeptide. For example, it means that when one intends to enhance the binding activity of a polypeptide to an Fcγ receptor, the binding activity is enhanced; when one intends to reduce the binding activity, the binding activity is decreased; when one intends to improve selectivity of binding activity, the selectivity is improved; and when one intends to improve physicochemical stability of a polypeptide, the stability is improved.

The present invention also includes a polypeptide which is characterized in that the Fc region is composed of a heterodimer comprising a first polypeptide and a second polypeptide, and which is characterized in having a higher Tm than that of a polypeptide characterized in that the polypeptide is composed of a homodimer comprising only the first polypeptide or is composed of a polypeptide characterized in that the Fc region is composed of a homodimer comprising only the second polypeptide. Along with an alteration that improves physicochemical stability, i.e., having a high Tm, the polypeptide may also have additional alterations to the Fc region function.

In a case where the additional alteration of Fc region function is enhancement of FcγRIa-binding activity, at least one or more amino acid mutations selected from the group consisting of the amino acid mutations described in Tables 31-1, 31-2, and 31-3 herein may be introduced into the amino acid sequences of the first polypeptide and/or the second polypeptide constituting the Fc region.

In a case where the additional alteration of Fc region function is enhancement of FcγRIIa R-binding activity, at least one or more amino acid mutations selected from the group consisting of the amino acid mutations described in Tables 32-1 and 32-2 herein may be introduced into the amino acid sequences of the first polypeptide and/or the second polypeptide constituting the Fc region.

In a case where the additional alteration of Fc region function is enhancement of FcγRIIa H-binding activity, at least one or more amino acid mutations selected from the group consisting of the amino acid mutations described in Tables 33-1 and 33-2 herein may be introduced into the amino acid sequences of the first polypeptide and/or the second polypeptide constituting the Fc region.

In a case where the additional alteration of Fc region function is enhancement of FcγRIIb-binding activity, at least one or more amino acid mutations selected from the group consisting of the amino acid mutations described in Tables 34-1 and 34-2 herein may be introduced into the amino acid sequences of the first polypeptide and/or the second polypeptide constituting the Fc region.

In a case where the additional alteration of Fc region function is enhancement of FcγRIIIa-binding activity, at least one or more amino acid mutations selected from the group consisting of the amino acid mutations described in Tables 35-1 and 35-2 herein may be introduced into the amino acid sequences of the first polypeptide and/or the second polypeptide constituting the Fc region.

In the present invention, the combination of the first polypeptide and the second polypeptide into which amino acid mutations are introduced is not particularly limited, and examples include combinations of different types/or the same type of polypeptides selected from the polypeptides described in SEQ ID NOs: 2 to 4 and 6 to 60. In addition, the preferred examples include a combination of polypeptides comprising the first polypeptide and the second polypeptide described in the Examples herein (a combination of the H chains of two antibodies and the L chain of a single antibody).

The polypeptide of the present invention may be an antigen-binding molecule. In the present invention, while the antibody-binding molecule is not particularly limited in type, preferred examples include an antibody, a bispecific antibody, or an Fc fusion molecule such as a peptide Fc fusion protein or a scaffold Fc fusion protein.

<Antibody>

Furthermore, an antibody is provided as a polypeptide of the present invention.

The term "antibody/antibodies" in the present invention is used in the broadest sense, and as long as the desired biological activity is shown, it comprises any antibody such as monoclonal antibodies (including full-length monoclonal antibodies), polyclonal antibodies, antibody variants, antibody fragments, polyspecific antibodies (for example, bispecific antibodies), chimeric antibodies, and humanized antibodies.

Regarding the antibodies of the present invention, the antigen type and antibody origin are not limited, and they may be any type of antibodies. The origin of the antibodies is not particularly limited, but examples include human antibodies, mouse antibodies, rat antibodies, and rabbit antibodies.

Methods for producing the antibodies are well known to those skilled in the art, and for example, monoclonal antibodies may be produced by the hybridoma method (Kohler and Milstein, Nature 256: 495 (1975)), or the recombination method (U.S. Pat. No. 4,816,567). Alternatively, they may be isolated from a phage antibody library (Clackson et al., Nature 352: 624-628 (1991); Marks et al., J. Mol. Biol. 222: 581-597 (1991)). Alternatively, they may be isolated from a single B cell clone (N. Biotechnol. 28(5): 253-457 (2011)).

A humanized antibody is also called a reshaped human antibody. Specifically, humanized antibodies prepared by grafting the CDRs of a non-human animal antibody such as a mouse antibody to a human antibody and such are known. Common genetic engineering technologies for obtaining humanized antibodies are also known. Specifically, for example, overlap extension PCR is known as a method for grafting mouse antibody CDRs to human FRs.

A vector for expressing a humanized antibody can be produced by inserting a DNA encoding an antibody variable region in which three CDRs and four FRs are ligated and a DNA encoding a human antibody constant region into an expression vector so that these DNAs are fused in frame. After this integration vector is transfected into a host to establish recombinant cells, these cells are cultured, and the DNA encoding the humanized antibody is expressed to produce the humanized antibody in the culture of the cells (see, European Patent Publication No. EP 239,400, and International Patent Publication No. WO 1996/002576).

As necessary, an amino acid residue in an FR may be substituted so that the CDRs of a reshaped human antibody form an appropriate antigen-binding site. For example, a mutation can be introduced into the amino acid sequence of an FR by applying the PCR method used for grafting mouse CDRs to human FRs.

A desired human antibody can be obtained by DNA immunization using a transgenic animal having the complete repertoire of human antibody genes (see International Publication Nos. WO 1993/012227, WO 1992/003918, WO 1994/002602, WO 1994/025585, WO 1996/034096, and WO 1996/033735) as an animal for immunization.

Furthermore, technologies for obtaining a human antibody by panning using a human antibody library are known. For example, a human antibody V region is expressed on the surface of a phage as a single-chain antibody (scFv) by the phage display method. The scFv-expressing phage that binds to the antigen can be selected. The DNA sequence that encodes the V region of the antigen-bound human antibody can be determined by analyzing the genes of the selected phage. After determining the DNA sequence of the scFv that binds to the antigen, an expression vector can be prepared by fusing the V-region sequence in-frame with the sequence of a desired human antibody C region, and then inserting this into a suitable expression vector. The expression vector is introduced into suitable expression cells such as those described above, and the human antibody can be obtained by expressing the human antibody-encoding gene. These methods are already known (see, International Publication Nos. WO 1992/001047, WO 1992/020791, WO 1993/006213, WO 1993/011236, WO 1993/019172, WO 1995/001438, and WO 1995/15388).

Variable regions constituting the antibodies of the present invention can be variable regions that recognize any antigen.

Herein, there is no particular limitation on the antigen, and it may be any antigens. Examples of the antigen include 17-IA, 4-1 BB, 4Dc, 6-keto-PGF1a, 8-iso-PGF2a, 8-oxo-dG, A1 Adenosine Receptor, A33, ACE, ACE-2, Activin, Activin A, Activin AB, Activin B, Activin C, Activin RIA, Activin RIA ALK-2, Activin RIB ALK-4, Activin RIIA, Activin RIIB, ADAM, ADAM10, ADAM12, ADAM15, ADAM17/TACE, ADAMS, ADAMS, ADAMTS, ADAMTS4, ADAMTS5, Addressins, adiponectin, ADP ribosyl cyclase-1, aFGF, AGE, ALCAM, ALK, ALK-1, ALK-7, allergen, alpha1-antichemotrypsin, alpha1-antitrypsin, alpha-synuclein, alpha-V/beta-1 antagonist, aminin, amylin, amyloid beta, amyloid immunoglobulin heavy chain variable region. amyloid immunoglobulin light chain variable region, Androgen, ANG, angiotensinogen, Angiopoietin ligand-2, anti-Id, antithrombinIII, Anthrax, APAF-1, APE, APJ, apo A1, apo serum amyloid A, Apo-SAA, APP, APRIL, AR, ARC, ART, Artemin, ASPARTIC, Atrial natriuretic factor, Atrial natriuretic peptide, atrial natriuretic peptides A, atrial natriuretic peptides B, atrial natriuretic peptides C, av/b3 integrin, Ax1, B7-1, B7-2, B7-H, BACE, BACE-1, *Bacillus anthracis* protective antigen, Bad, BAFF, BAFF-R, Bag-1, BAK, Bax, BCA-1, BCAM, BcI, BCMA, BDNF, b-ECGF, beta-2-microglobulin, betalactamase, bFGF, BID, Bik, BIM, BLC, BL-CAM, BLK, B-lymphocyte Stimulator (BIyS), BMP, BMP-2 (BMP-2a), BMP-3 (Osteogenin), BMP-4 (BMP-2b), BMP-5, BMP-6 (Vgr-1), BMP-7 (OP-1), BMP-8 (BMP-8a), BMPR, BMPR-IA (ALK-3), BMPR-IB (ALK-6), BMPR-II (BRK-3), BMPs, BOK, Bombesin, Bone-derived neurotrophic factor, bovine growth hormone, BPDE, BPDE-DNA, BRK-2, BTC, B-lymphocyte cell adhesion molecule, C10, C1-inhibitor, C1q, C3, C3a, C4, C5, C5a (complement 5a), CA125, CAD-8, Cadherin-3, Calcitonin, cAMP, Carbonic anhydrase-IX, carcinoembryonic antigen (CEA), carcinoma-associated antigen, Cardiotrophin-1, Cathepsin A, Cathepsin B, Cathepsin C/DPPI, Cathepsin D, Cathepsin E, Cathepsin H, Cathepsin L, Cathepsin O, Cathepsin S, Cathepsin V, Cathepsin X/Z/P, CBL, CCI, CCK2, CCL, CCL1/I-309, CCL11/Eotaxin, CCL12/MCP-5, CCL13/MCP-4, CCL14/HCC-1, CCL15/HCC-2, CCL16/HCC-4, CCL17/TARC, CCL18/PARC, CCL19/ELC, CCL2/MCP-1, CCL20/MIP-3-alpha, CCL21/SLC, CCL22/MDC, CCL23/MPIF-1, CCL24/Eotaxin-2, CCL25/TECK, CCL26/Eotaxin-3, CCL27/CTACK, CCL28/MEC, CCL3/M1P-1-alpha, CCL3L1/LD-78-beta, CCL4/MIP-1-beta, CCL5/RANTES, CCL6/C10, CCL7/MCP-3, CCL8/MCP-2, CCL9/10/MTP-1-gamma, CCR, CCR1, CCR10, CCR2, CCR3, CCR4, CCR5, CCR6, CCR7, CCR8, CCR9, CD1, CD10, CD105, CD11a, CD11b, CD11c, CD123, CD13, CD137, CD138, CD14, CD140a, CD146, CD147, CD148, CD15, CD152, CD16, CD164, CD18, CD19, CD2, CD20, CD21, CD22, CD23, CD25, CD26, CD27L, CD28, CD29, CD3, CD30, CD30L, CD32, CD33 (p67 proteins), CD34, CD37, CD38, CD3E, CD4, CD40, CD40L, CD44, CD45, CD46, CD49a, CD49b, CD5, CD51, CD52, CD54, CD55, CD56, CD6, CD61, CD64, CD66e, CD7, CD70, CD74, CD8, CD80 (B7-1), CD89, CD95, CD105, CD158a, CEA, CEACAMS, CFTR, cGMP, CGRP receptor, CINC, CKb8-1, Claudin18, CLC, *Clostridium botulinum* toxin, *Clostridium difficile* toxin, *Clostridium perfringens* toxin, c-Met, CMV, CMV UL, CNTF, CNTN-1, complement factor 3 (C3), complement factor D, corticosteroid-binding globulin, Colony stimulating factor-1 receptor, COX, C-Ret, CRG-2, CRTH2, CT-1, CTACK, CTGF, CTLA-4, CX3CL1/Fractalkine, CX3CR1, CXCL, CXCL1/Gro-alpha, CXCL10, CXCL11/I-TAC, CXCL12/SDF-1-alpha/beta, CXCL13/BCA-1, CXCL14/BRAK, CXCL15/Lungkine. CXCL16, CXCL16, CXCL2/Gro-beta CXCL3/Gro-gamma, CXCL3, CXCL4/PF4, CXCL5/ENA-78, CXCL6/GCP-2, CXCL7/NAP-2, CXCL8/IL-8, CXCL9/Mig, CXCL10/IP-10, CXCR, CXCR1, CXCR2, CXCR3, CXCR4, CXCR5, CXCR6, cystatin C, cytokeratin tumor-associated antigen, DAN, DCC, DcR3, DC-SIGN, Decay accelerating factor, Delta-like protein ligand 4, des(1-3)-IGF-1 (brain IGF-1), Dhh, DHICA oxidase, Dickkopf-1, digoxin, Dipeptidyl peptidase IV, DK1, DNAM-1, Dnase, Dpp, DPPIV/CD26, Dtk, ECAD, EDA, EDA-A1, EDA-A2, EDAR, EGF, EGFR (ErbB-1), EGF like domain containing protein 7, Elastase, elastin, EMA, EMMPRIN, ENA, ENA-78, Endosialin, endothelin receptor, endotoxin, Enkephalinase, eNOS, Eot, Eotaxin, Eotaxin-2, eotaxini, EpCAM, Ephrin B2/EphB4, Epha2 tyrosine kinase receptor, epidermal growth factor receptor (EGFR), ErbB2 receptor, ErbB3 tyrosine kinase receptor, ERCC, EREG, erythropoietin (EPO), Erythropoietin receptor, E-selectin, ET-1, Exodus-2, F protein of RSV, F10, F11, F12, F13, F5, F9, Factor Ia, Factor IX, Factor Xa, Factor VII, factor VIII, Factor VIIIc, Fas, FcalphaR, FcepsilonRI, FcgammaIIb, FcgammaRI, FcgammaRIIa, FcgammaRIIIa, FcgammaRIIIb, FcRn, FEN-1, Ferritin, FGF, FGF-19, FGF-2, FGF-2 receptor, FGF-3, FGF-8, FGF-acidic, FGF-basic, FGFR, FGFR-3, Fibrin, fibroblast activation protein (FAP), fibroblast growth factor, fibroblast growth factor-10, fibronectin, FL, FLIP, Flt-3, FLT3 ligand, Folate receptor, follicle stimulating hormone (FSH), Fractalkine (CX3C), free heavy chain, free light chain, FZD1, FZD10, FZD2, FZD3, FZD4, FZD5, FZD6, FZD7, FZD8, FZD9, G250, Gas 6, GCP-2, GCSF, G-CSF, G-CSF receptor, GD2, GD3, GDF, GDF-1, GDF-15 (MIC-1), GDF-3 (Vgr-2), GDF-5 (BMP-14/CDMP-1), GDF-6 (BMP-13/CDMP-2), GDF-7 (BMP-12/CDMP-3), GDF-8 (Myostatin), GDF-9, GDNF, Gelsolin, GFAP, GF-CSF, GFR-alpha1, GFR-alpha2, GFR-alpha3, GF-131, gH envelope glycoprotein, GITR, Glucagon, Glucagon receptor, Glucagon-like peptide 1 receptor, Glut 4, Glutamate carboxypeptidase II, glycoprotein hormone receptors, glycoprotein IIb/IIIa (GP IIb/IIIa), Glypican-3, GM-CSF, GM-CSF receptor, gp130, gp140, gp72, granulocyte-CSF (G-CSF), GRO/MGSA, Growth hormone releasing factor, GRO-13, GRO-γ, *H. pylori*, Hapten (NP-cap or NIP-cap), HB-EGF, HCC, HCC 1, HCMV gB envelope glycoprotein, HCMV UL, Hemopoietic growth factor (HGF), Hep B gp120, heparanase, heparin cofactor II, hepatic growth factor, *Bacillus anthracis* protective antigen, Hepatitis C virus E2 glycoprotein, Hepatitis E, Hepcidin, Her1, Her2/neu (ErbB-2), Her3 (ErbB-3), Her4 (ErbB-4), herpes simplex virus (HSV) gB glycoprotein, HGF, HGFA, High molecular weight melanoma-associated antigen (HMW-MAA), HIV envelope proteins such as GP120, HIV MIB gp 120 V3 loop, HLA, HLA-DR, HM1.24, HMFG PEM, HMGB-1, HRG, Hrk, HSP47, Hsp90, HSV gD glycoprotein, human cardiac myosin, human cytomegalovirus (HCMV), human growth hormone (hGH), human serum albumin, human tissue-type plasminogen activator (t-PA), Huntingtin, HVEM, IAP, ICAM, ICAM-1, ICAM-3, ICE, ICOS, IFN-alpha, IFN-beta, IFN-gamma, IgA, IgA receptor, IgE, IGF, IGF binding proteins, IGF-1, IGF-1 R, IGF-2, IGFBP, IGFR, IL, IL-1, IL-10, IL-10 receptors, IL-11, IL-11 receptors, IL-12, IL-12 receptors, IL-13, IL-13 receptors, IL-15, IL-15 receptors, IL-16, IL-16 receptors, IL-17, IL-17 receptors, IL-18 (IGIF), IL-18 receptors, IL-1alpha, IL-1beta, IL-1 receptors, IL-2, IL-2 receptors, IL-20, IL-20 receptors, IL-21, IL-21 receptors, IL-23, IL-23 receptors, IL-2 receptors, IL-3, IL-3 receptors, IL-31, IL-31 receptors, IL-3 receptors, IL-4, IL-4 receptors IL-5, IL-5 receptors, IL-6, IL-6 receptors, IL-7, IL-7 receptors, IL-8, IL-8 receptors, IL-9, IL-9 receptors, immunoglobulin immune complex, immunoglobulins, INF-alpha, INF-alpha receptors, INF-beta, INF-beta receptors, INF-gamma, INF-gamma receptors, IFN type-I, IFN type-I receptor, influenza, inhibin, Inhibin α, Inhibin β, iNOS, insulin, Insulin A-chain, Insulin B-chain, Insulin-like growth factor 1, insulin-like growth factor 2, insulin-like growth factor binding proteins, integrin, integrin alpha2, integrin alpha3, integrin alpha4, integrin alpha4/beta1, integrin alpha-V/beta-3, integrin alpha-V/beta-6, integrin alpha4/beta7, integrin alpha5/beta1, integrin alpha5/beta3, integrin alpha5/beta6, integrin alphaσ (alphaV), integrin alphaθ, integrin beta1, integrin beta2, integrin beta3 (GPIIb-IIIa), IP-10, I-TAC, JE, kalliklein, Kallikrein 11, Kallikrein 12, Kallikrein 14, Kallikrein 15, Kallikrein 2, Kallikrein 5, Kallikrein 6, Kallikrein L1, Kallikrein L2, Kallikrein L3, Kallikrein L4, kallistatin, KC, KDR, Keratinocyte Growth Factor (KGF), Keratinocyte Growth Factor-2 (KGF-2), KGF, killer immunoglobulin-like receptor, kit ligand (KL), Kit tyrosine kinase, laminin 5, LAMP, LAPP (Amylin, islet-amyloid polypeptide), LAP (TGF-1), latency associated peptide, Latent TGF-1, Latent TGF-1 bp1, LBP, LDGF, LDL, LDL receptor, LECT2, Lefty, Leptin, leutinizing hormone (LH), Lewis-Y antigen, Lewis-Y related antigen, LFA-1, LFA-3, LFA-3 receptors, Lfo, LIF, LIGHT, lipoproteins, LIX, LKN, Lptn, L-Selectin, LT-a, LT-b, LTB4, LTBP-1, Lung surfactant, Luteinizing hormone, Lymphotactin, Lymphotoxin Beta Receptor, Lysosphingolipid receptor, Mac-1, macrophage-CSF (M-CSF), MAdCAM, MAG, MAP2, MARC, maspin, MCAM, MCK-2, MCP, MCP-1, MCP-2, MCP-3, MCP-4, MCP-I (MCAF), M-CSF, MDC, MDC (67 a.a.), MDC (69 a.a.), megsin, Mer, MET tyrosine kinase receptor family, METALLOPROTEASES, Membrane glycoprotein OX2, Mesothelin, MGDF receptor, MGMT, MHC (HLA-DR), microbial protein, MIF, MIG, MIP, MIP-1α, MIP-1β, MIP-3α, MIP-3β, MIP-4, MK, MMAC1, MMP, MMP-1, MMP-10, MMP-11, MMP-12, MMP-13, MMP-14, MMP-15, MMP-2, MMP-24, MMP-3, MMP-7, MMP-8, MMP-9, monocyte attractant protein, monocyte colony inhibitory factor, mouse gonadotropin-associated peptide, MPIF, Mpo, MSK, MSP, MUC-16, MUC18, mucin (Mud), Muellerian-inhibiting substance, Mug, MuSK, Myelin associated glycoprotein, myeloid progenitor inhibitor factor-1 (MPIF-I), NAIP, Nanobody, NAP, NAP-2, NCA 90, NCAD, N-Cadherin, NCAM, Neprilysin, Neural cell adhesion molecule, neroserpin, Neuronal growth factor (NGF), Neurotrophin-3, Neurotrophin-4, Neurotrophin-6, Neuropilin 1, Neurturin, NGF-beta, NGFR, NKG20, N-methionyl human growth hormone, nNOS, NO, Nogo-A, Nogo receptor, non-structural protein type 3 (NS3) from the hepatitis C virus, NOS, Npn, NRG-3, NT, NT-3, NT-4, NTN, OB, OGG1, Oncostatin M, OP-2, OPG, OPN, OSM, OSM receptors, osteoinductive factors, osteopontin, OX40L, OX40R, oxidized LDL, p150, p95, PADPr, parathyroid hormone, PARC, PARP, PBR, PBSF, PCAD, P-Cadherin, PCNA, PCSK9, PDGF, PDGF receptor, PDGF-AA, PDGF-AB, PDGF-BB, PDGF-D, PDK-1, PECAM, PEDF, PEM, PF-4, PGE, PGF, PGI2, PGD2, PIGF, PIN, PLA2, Placenta growth factor, placental alkaline phosphatase (PLAP), placental lactogen, plasminogen activator inhibitor-1, platelet-growth factor, plgR, PLP, poly glycol chains of different size (e.g. PEG-20, PEG-30, PEG40), PP14, prekallikrein, prion protein, procalcitonin, Programmed cell death protein 1, proinsulin, prolactin, Proprotein convertase PC9, prorelaxin, prostate specific membrane antigen (PSMA), Protein A, Protein C, Protein D, Protein S, Protein Z, PS, PSA, PSCA, PsmAr, PTEN, PTHrp, Ptk, PTN, P-selectin glycoprotein ligand-1, R51, RAGE, RANK, RANKL, RANTES, relaxin, Relaxin A-chain, Relaxin B-chain, renin, respiratory syncytial virus (RSV) F, Ret, reticulon 4, Rheumatoid factors, RLI P76, RPA2, RPK-1, RSK, RSV Fgp, S100, RON-8, SCF/KL, SCGF, Sclerostin, SDF-1, SDF1α, SDF1β, SERINE, Serum Amyloid P, Serum albumin, sFRP-3, Shh, Shiga like toxin II, SIGIRR, SK-1, SLAM, SLPI, SMAC, SMDF, SMOH, SOD, SPARC, sphingosine 1-phosphate receptor 1, Staphylococcal lipoteichoic acid, Stat, STEAP, STEAP-II, stem cell factor (SCF), streptokinase, superoxide dismutase, syndecan-1, TACE, TACI, TAG-72 (tumor-associated glycoprotein-72), TARC, TB, TCA-3, T-cell receptor alpha/beta, TdT, TECK, TEM1, TEMS, TEM7, TEM8, Tenascin, TERT, testicular PLAP-like alkaline phosphatase, TfR, TGF, TGF-alpha, TGF-beta, TGF-beta Pan Specific, TGF-beta RII, TGF-beta RIIb, TGF-beta RIII, TGF-beta R1 (ALK-5), TGF-beta1, TGF-beta2, TGF-beta3, TGF-beta4, TGF-beta5, TGF-I, Thrombin, thrombopoietin (TPO), Thymic stromal lymphoprotein receptor, Thymus Ck-1, thyroid stimulating hormone (TSH), thyroxine, thyroxine-binding globulin, Tie, TIMP, TIQ, Tissue Factor, tissue factor protease inhibitor, tissue factor protein, TMEFF2, Tmpo, TMPRSS2, TNF receptor I, TNF receptor II, TNF-alpha, TNF-beta, TNF-beta2, TNFc, TNF-RI, TNF-RII, TNFRSF10A (TRAIL R1 Apo-2/DR4), TNFRSF10B (TRAIL R2 DR5/KILLER/TRICK-2A/TRICK-B), TNFRSF10C (TRAIL R3 DcR1/LIT/TRID), TNFRSF10D (TRAIL R4 DcR2/TRUNDD), TNFRSF11A (RANK ODF R/TRANCE R), TNFRSF11B (OPG OCIF/TR1), TNFRSF12 (TWEAK R FN14), TNFRSF12A, TNFRSF13B (TACI), TNFRSF13C (BAFF R), TNFRSF14 (HVEM ATAR/HveA/LIGHT R/TR2), TNFRSF16 (NGFR p75NTR), TNFRSF17 (BCMA), TNFRSF18 (GITR AITR), TNFRSF19 (TROY TAJ/TRADE), TNFRSF19L (RELT), TNFRSF1A (TNF R1 CD120a/p55-60), TNFRSF1B (TNF RH CD120b/p75-80), TNFRSF21 (DR6), TNFRSF22 (DcTRAIL R2 TNFRH2), TNFRSF25 (DR3 Apo-3/LARD/TR-3/TRAMP/WSL-1), TNFRSF26 (TNFRH3), TNFRSF3 (LTbR TNF RIII/TNFC R), TNFRSF4 (OX40 ACT35/TXGP1 R), TNFRSF5 (CD40 p50), TNFRSF6 (Fas Apo-1/APT1/CD95), TNFRSF6B (DcR3 M68/TR6), TNFRSF7 (CD27), TNFRSF8 (CD30), TNFRSF9 (4-1 BB CD137/ILA), TNFRST23 (DcTRAIL R1 TNFRH1), TNFSF10 (TRAIL Apo-2 Ligand/TL2), TNFSF11 (TRANCE/RANK Ligand ODF/OPG Ligand), TNFSF12 (TWEAK Apo-3 Ligand/DR3 Ligand), TNFSF13 (APRIL TALL2), TNFSF13B (BAFF BLYS/TALL1/THANK/TNFSF20), TNFSF14 (LIGHT HVEM Ligand/LTg), TNFSF15 (TL1A/VEGI), TNFSF18 (GITR Ligand AITR Ligand/TL6), TNFSF1A (TNF-a Conectin/DIF/TNFSF2), TNFSF1B (TNF-b LTa/TNFSF1), TNFSF3 (LTb TNFC/p33), TNFSF4 (OX40 Ligand gp34/TXGP1), TNFSF5 (CD40 Ligand CD154/gp39/HIGM1/IMD3/TRAP), TNFSF6 (Fas Ligand Apo-1 Ligand/APT1 Ligand), TNFSF7 (CD27 Ligand CD70), TNFSF8 (CD30 Ligand CD153), TNFSF9 (4-1 BB Ligand CD137 Ligand), TNF-α, TNF-β, TNIL-I, toxic metabolite, TP-1, t-PA, Tpo, TRAIL, TRAIL R, TRAIL-R1, TRAIL-R2, TRANCE, transferrin receptor, transforming growth factors (TGF) such as TGF-alpha and TGF-beta, Transmembrane glycoprotein NMB, Transthyretin, TRF, Trk, TROP-2, Trophoblast glycoprotein, TSG, TSLP, Tumor Necrosis Factor (TNF), tumor-associated antigen CA 125, tumor-associated antigen expressing Lewis Y related carbohydrate, TWEAK, TXB2, Ung, uPAR, uPAR-1, Urokinase, VAP-1, vascular endothelial growth factor (VEGF), vaspin, VCAM, VCAM-1, VECAD, VE-Cadherin, VE-Cadherin-2, VEFGR-1 (flt-1), VEFGR-2, VEGF receptor (VEGFR), VEGFR-3 (flt-4), VEGI, VIM, Viral antigens, VitB12 receptor, Vitronectin receptor, VLA, VLA-1, VLA-4, VNR integrin, von Willebrand Factor (vWF), WIF-1, WNT1, WNT10A, WNT10B, WNT11, WNT16, WNT2, WNT2B/13, WNT3, WNT3A, WNT4, WNT5A, WNT5B, WNT6, WNT7A, WNT7B, WNT8A, WNT8B, WNT9A, WNT9B, XCL1, XCL2/SCM-1-beta, XCL1/Lymphotactin, XCR1, XEDAR, XIAP, XPD.

One or more amino acid residue alterations are allowed in the amino acid sequences constituting the variable regions as long as their antigen-binding activities are maintained. When altering a variable region amino acid sequence, there is no particularly limitation on the site of alteration and number of amino acids altered. For example, amino acids present in CDR and/or FR can be altered appropriately. When altering amino acids in a variable region, the binding activity is preferably maintained without particular limitation; and for example, as compared to before alteration, the binding activity is 50% or more, preferably 80% or more, and more preferably 100% or more. Furthermore, the binding activity may be increased by amino acid alterations. For example, the binding activity may be 2-, 5-, 10-times higher or such than that before alteration. In the antibodies of the present invention, alteration of amino acid sequence may be at least one of amino acid residue substitution, addition, deletion, insertion, and modification.

For example, the modification of the N-terminal glutamine of a variable region into pyroglutamic acid by pyroglutamylation is a modification well known to those skilled in the art. Thus, when the heavy-chain N terminus is glutamine, the antibodies of the present invention comprise the variable regions in which the glutamine is modified to pyroglutamic acid.

Antibody variable regions of the present invention may have any sequences, and they may be antibody variable regions of any origin, such as mouse antibodies, rat antibodies, rabbit antibodies, goat antibodies, camel antibodies, humanized antibodies produced by humanizing these non-human antibodies, and human antibodies. "Humanized antibodies", also referred to as "reshaped human antibodies", are antibodies in which the complementarity determining regions (CDRs) of an antibody derived from a non-human mammal, for example, a mouse antibody, are transplanted into the CDRs of a human antibody. Methods for identifying CDRs are known (Kabat et al., Sequence of Proteins of Immunological Interest (1987), National Institute of Health, Bethesda, Md.; Chothia et al., Nature (1989) 342: 877). Their common genetic recombination technologies are also known (see, European Patent Application Publication No. EP 125023 and WO 96/02576). Furthermore, these antibodies may have various amino acid substitutions introduced into their variable regions to improve their antigen binding, pharmacokinetics, stability, and antigenicity. Variable regions of the antibodies of the present invention may be able to bind antigens repeatedly due to their pH dependability in antigen binding (WO/2009/125825).

κ chain and λ chain-type constant regions are present in antibody light-chain constant regions, but either one of the light chain constant regions is acceptable. Furthermore, light-chain constant regions of the present invention may be light-chain constant regions with amino acid alterations such as substitutions, additions, deletions, insertions, and/or modifications.

For example, for the heavy chain constant regions of an antibody of the present invention, heavy chain constant regions of human IgG antibodies may be used and heavy chain constant regions of human IgG1 antibodies are preferred.

The variable regions constituting an antibody of the present invention can be variable regions that recognize any antigen. One or several amino acid residues in the amino acid sequence constituting a heavy chain variable region can be altered as long as the antigen-binding activity is maintained.

Furthermore, alteration of variable regions is carried out with the objective of increasing binding activity, improving specificity, lowering pI, conferring a pH-dependent property to antigen binding, improving thermal stability of binding, improving solubility, providing stability to chemical modification, improving sugar-chain-derived heterogeneity, avoiding T cell epitope that reduces immunogenicity identified by in silico prediction, or by an in vitro assay using T cells, introducing T cell epitope that activates regulatory T cells, or such (mAbs 3: 243-247, 2011).

Furthermore, a polypeptide of the present invention may be an Fc fusion protein molecule produced by linking an Fc region with another protein, a biologically active peptide, or such (peptide Fc fusion protein), or an Fc fusion protein molecule produced by linking an Fc region with an extracellular matrix composed of polymers such as collagen or polylactic acid (scaffold Fc fusion protein).

Examples of another protein or biologically active peptide include receptors, adhesion molecules, ligands, and enzymes, but are not limited thereto.

Preferred examples of Fc fusion protein molecules of the present invention include proteins with Fc domain fused to a receptor protein that binds to a target, and such examples include TNFR-Fc fusion protein, IL1R-Fc fusion protein, VEGFR-Fc fusion protein, and CTLA4-Fc fusion protein (Nat Med. 2003 January; 9(1): 47-52; BioDrugs. 2006; 20(3): 151-60). Furthermore, a protein to be fused to a polypeptide of the present invention may be any molecule as long as it binds to a target molecule, and examples include scFv molecules (WO 2005/037989), single-domain antibody molecules (WO 2004/058821; WO 2003/002609), antibody-like molecules (Current Opinion in Biotechnology 2006, 17: 653-658; Current Opinion in Biotechnology 2007, 18: 1-10; Current Opinion in Structural Biology 1997, 7: 463-469; and Protein Science 2006, 15: 14-27) such as DARPins (WO 2002/020565), Affibody (WO 1995/001937), Avimer (WO 2004/044011; WO 2005/040229), and Adnectin (WO 2002/032925). Furthermore, antibodies and Fc fusion protein molecules may be multispecific antibodies that bind to multiple types of target molecules or epitopes such as bispecific antibodies.

Furthermore, the antibodies of the present invention include antibody modification products. Such antibody modification products include, for example, antibodies linked with various molecules such as polyethylene glycol (PEG) and cytotoxic substances. Such antibody modification products can be obtained by chemically modifying antibodies of the present invention. Methods for modifying antibodies are already established in this field.

The antibodies of the present invention may also be bispecific antibodies. "Bispecific antibody" refers to an antibody that has in a single antibody molecule variable regions that recognize different epitopes. The epitopes may be present in a single molecule or in different molecules.

The polypeptides of the present invention can be prepared by the methods known to those skilled in the art. For example, the antibodies can be prepared by the methods described below, but the methods are not limited thereto.

There are various known host cell/expression vector combinations for antibody preparation by introducing isolated genes encoding the polypeptide into appropriate hosts. All of these expression systems are applicable to isolation of the antigen-binding molecules of the present invention. Appropriate eukaryotic cells used as host cells include animal cells, plant cells, and fungal cells. Specifically, the animal cells include, for example, the following cells.

(1) mammalian cells: CHO (Chinese hamster ovary cell line), COS (Monkey kidney cell line), myeloma (Sp2/O, NS0 and such), BHK (baby hamster kidney cell line), HEK293 (human embryonic kidney cell line with sheared adenovirus (Ad)5 DNA), PER.C6 cell (human embryonic retinal cell line transformed with the Adenovirus Type 5 (Ad5) E1A and E1B genes), Hela, Vero, or such (Current Protocols in Protein Science (May, 2001, Unit 5.9, Table 5.9.1));

(2) amphibian cells: *Xenopus* oocytes, or such; and (3) insect cells: sf9, sf21, Tn5, or such.

A DNA encoding an antibody heavy chain in which one or more amino acid residues in the Fc region have been substituted with other amino acids of interest and DNA encoding an antibody light chain, are expressed. A DNA encoding a heavy chain in which one or more amino acid residues in the Fc region are substituted with other amino acids of interest can be prepared, for example, by obtaining a DNA encoding the Fc region of a natural heavy chain, and introducing an appropriate substitution so that a codon encoding a particular amino acid in the Fc region encodes another amino acid of interest.

Alternatively, a DNA encoding a heavy chain in which one or more amino acid residues in the Fc region are substituted with other amino acids of interest can also be prepared by designing and then chemically synthesizing a DNA encoding a protein in which one or more amino acid residues in the Fc region of the natural heavy chain are substituted with other amino acids of interest. The position and type of amino acid substitution are not particularly limited. Furthermore, alteration is not limited to substitution, and alteration may be any of deletion, addition, or insertion, or combination thereof.

Alternatively, a DNA encoding a heavy chain in which one or more amino acid residues in the Fc region are substituted with other amino acids of interest can be prepared as a combination of partial DNAs. Such combinations of partial DNAs include, for example, the combination of a DNA encoding a variable region and a DNA encoding a constant region, and the combination of a DNA encoding an Fab region and a DNA encoding an Fc region, but are not limited thereto. Furthermore, a DNA encoding a light chain can similarly be prepared as a combination of partial DNAs.

Methods for expressing the above-described DNAs include the methods described below. For example, a heavy chain expression vector is constructed by inserting a DNA encoding a heavy chain variable region into an expression vector along with a DNA encoding a heavy chain constant region. Likewise, a light chain expression vector is constructed by inserting a DNA encoding a light chain variable region into an expression vector along with a DNA encoding a light chain constant region. Alternatively, these heavy and light chain genes may be inserted into a single vector.

When inserting a DNA encoding the antibody of interest into an expression vector, the DNA is inserted so that the antibody is expressed under the control of an expression-regulating region such as an enhancer or promoter. Next, host cells are transformed with this expression vector to express the antibody. In such cases, an appropriate combination of host and expression vector may be used.

Examples of the vectors include M13 vectors, pUC vectors, pBR322, pBluescript, and pCR-Script. Alternatively, when aiming to subclone and excise cDNA, in addition to the vectors described above, pGEM-T, pDIRECT, pT7, and such can be used.

Expression vectors are particularly useful when using vectors for producing the antibodies of the present invention. For example, when a host cell is *E. coli* such as JM109, DH5α, HB101, and XL1-Blue, the expression vectors must carry a promoter that allows efficient expression in *E. coli*, for example, lacZ promoter (Ward et al., Nature (1989) 341: 544-546; FASEB J. (1992) 6: 2422-2427; its entirety are incorporated herein by reference), araB promoter (Better et al., Science (1988) 240: 1041-1043; its entirety are incorporated herein by reference), T7 promoter, or such. Such vectors include pGEX-5X-1 (Pharmacia), "QIAexpress system" (QIAGEN), pEGFP, or pET (in this case, the host is preferably BL21 that expresses T7 RNA polymerase) in addition to the vectors described above.

The vectors may contain signal sequences for polypeptide secretion. As a signal sequence for polypeptide secretion, a pelB signal sequence (Lei, S. P. et al J. Bacteriol. (1987) 169: 4379; its entirety are incorporated herein by reference) may be used when a polypeptide is secreted into the *E. coli* periplasm. The vector can be introduced into host cells by lipofectin method, calcium phosphate method, and DEAE-Dextran method, for example.

In addition to *E. coli* expression vectors, the vectors for producing the polypeptides of the present invention include mammalian expression vectors (for example, pcDNA3 (Invitrogen), pEGF-BOS (Nucleic Acids. Res. 1990, 18(17): p5322; its entirety are incorporated herein by reference), pEF, and pCDM8), insect cell-derived expression vectors (for example, the "Bac-to-BAC baculovirus expression system" (GIBCO BRL) and pBacPAK8), plant-derived expression vectors (for example, pMH1 and pMH2), animal virus-derived expression vectors (for example, pHSV, pMV, and pAdexLcw), retroviral expression vectors (for example, pZIPneo), yeast expression vectors (for example, "Pichia Expression Kit" (Invitrogen), pNV11, and SP-Q01), and *Bacillus subtilis* expression vectors (for example, pPL608 and pKTH50), for example.

When aiming for expression in animal cells such as CHO, COS, NIH3T3, and HEK293 cells, the vectors must have a promoter essential for expression in cells, for example, SV40 promoter (Mulligan et al., Nature (1979) 277: 108; its entirety are incorporated herein by reference), MMTV-LTR promoter, EF 1a promoter (Mizushima et al., Nucleic Acids Res. (1990) 18: 5322; its entirety are incorporated herein by reference), CAG promoter (Gene. (1990) 18: 5322; its entirety are incorporated herein by reference), and CMV promoter, and more preferably they have a gene for selecting transformed cells (for example, a drug resistance gene that allows evaluation using an agent (neomycin, G418, or such)). Vectors with such characteristics include pMAM, pDR2, pBK-RSV, pBK-CMV, pOPRSV, and pOP13, for example. Also, in some cases, the EBNA1 protein may be further co-expressed for the purpose of increasing the gene copy number, and in this case, a vector having a replication initiation point OriP is used. (Biotechnol. Bioeng. 2001 Oct. 20; 75(2): 197-203; and Biotechnol. Bioeng. 2005 Sep. 20; 91(6): 670-7.)

In addition, the following method can be used for stable gene expression and gene copy number amplification in cells: CHO cells deficient in a nucleic acid synthesis pathway are introduced with a vector that carries a DHFR gene which compensates for the deficiency (for example, pCHOI), and the vector is amplified using methotrexate (MTX). Alternatively, the following method can be used for transient gene expression: COS cells with a gene expressing SV40 T antigen on their chromosome are transformed with a vector with an SV40 replication origin (pcD and such). Replication origins derived from polyoma virus, adenovirus, bovine papilloma virus (BPV), and such can also be used. To amplify gene copy number in host cells, the expression vectors may further carry selection markers such as aminoglycoside transferase (APH) gene, thymidine kinase (TK) gene, *E. coli* xanthine-guanine phosphoribosyltransferase (Ecogpt) gene, and dihydrofolate reductase (dhfr) gene.

Antibodies can be collected, for example, by culturing transformed cells, and then separating the antibodies from the inside of the transformed cells or from the culture media. Antibodies can be separated and purified using an appropriate combination of methods such as centrifugation, ammonium sulfate fractionation, salting out, ultrafiltration, 1q, FcRn, protein A, protein G column, affinity chromatography, ion exchange chromatography, and gel filtration chromatography.

As an efficient method for producing bispecific antibodies, the Knobs-into-holes technology may be used. Specifically, to produce a heterodimerized polypeptide of the present invention, it is necessary to have association between polypeptides having amino acids that differ from each other, or to separate the heterodimerized polypeptide of interest from the other homodimerized polypeptides.

For association of polypeptides having different amino acids from each another and comprising an Fc region, a technology of suppressing unintended association between H chains by introducing electrostatic repulsion into the interface of the second constant region of the antibody H chain (CH2) or the third constant region of the H chain (CH3) (WO 2006/106905) can be applied.

In the technology of suppressing unintended association between H chains by introducing electrostatic repulsion into the interface of CH2 or CH3, examples of amino acid residues in contact at the interface of other constant regions of the H chain include the residue at position 356 (EU numbering), the residue at position 439 (EU numbering), the region facing the residue at position 357 (EU numbering), the residue at position 370 (EU numbering), the residue at position 399 (EU numbering), and the residue at position 409 (EU numbering) in the CH3 domain.

More specifically, for example, in an antibody containing two types of H chain CH3 domains, the antibody in which one to three pairs of amino acid residues selected from the amino acid residues shown below in (1) to (3) in the first H chain CH3 domain have the same type of charge can be produced:

(1) amino acid residues at positions 356 and 439 (EU numbering) which are amino acid residues contained in the H chain CH3 domain;

(2) amino acid residues at positions 357 and 370 (EU numbering) which are amino acid residues contained in the H chain CH3 domain; and (3) amino acid residues at positions 399 and 409 (EU numbering) which are amino acid residues contained in the H chain CH3 domain.

Furthermore, an antibody can be produced in which one to three pairs of amino acid residues corresponding to the amino acid residue pairs indicated above in (1) to (3) having the same type of charge in the first H chain CH3 domain have charges opposite to the corresponding amino acid residues in the aforementioned first H chain CH3 domain, wherein the amino acid residue pairs are selected from the amino acid residue pairs indicated above in (1) to (3) in the second H chain CH3 domain which differs from the first H chain CH3 domain.

The respective amino acid residues of (1) to (3) mentioned above are positioned close to each other when associated. Those skilled in the art can find sites that correspond to the above-mentioned amino acid residues of (1) to (3) by homology modeling and such using commercially available software for the desired H chain CH3 domain or H chain constant region, and amino acid residues of these sites can be altered when appropriate.

In the above-mentioned antibodies, for example, "charged amino acid residues" are preferably selected from amino acid residues included in either of groups (X) or (Y) below:
(X) glutamic acid (E) and aspartic acid (D); and
(Y) lysine (K), arginine (R), and histidine (H).

In the above-mentioned antibodies, the phrase "having the same type of charge" means that, for example, all of the two or more amino acid residues are amino acid residues included in either of the above-mentioned groups (X) and (Y). The phrase "having the opposite charge" means that, for example, when at least one of the two or more amino acid residues is an amino acid residue included in either one of the above-mentioned groups (X) and (Y), the remaining amino acid residues are amino acid residues included in the other group.

In a preferred embodiment of the above-mentioned antibody, the first H chain CH3 domain and the second H chain CH3 domain may be cross-linked by disulfide bonds.

In the present invention, the amino acid residues to be altered are not limited to amino acid residues of the antibody constant region or antibody variable region described above. Those skilled in the art can find amino acid residues that form the interface in polypeptide mutants or heteromultimers through homology modeling and such using commercially available software, and can alter the amino acid residues at those sites to regulate association.

Other known technologies can also be used for the association of polypeptides of the present invention having different amino acids and comprising an Fc region. Polypeptides having different amino acids and comprising an Fc region can be efficiently associated with each other by substituting an amino acid side chain present in one of the H chain variable regions of the antibody with a larger side chain (knob), and substituting an amino acid side chain present in the opposing variable region of the other H chain with a smaller side chain (hole), to allow placement of the knob within the hole (WO 1996/027011; and Ridgway J B et al., Protein Engineering (1996) 9, 617-621; Merchant A M et al. Nature Biotechnology (1998) 16, 677-681).

In addition, other known technologies can also be used for the association of polypeptides having different amino acids and comprising an Fc region. Association of polypeptides having different sequences can be induced efficiently by complementary association of CH3, by using a strand-exchange engineered domain CH3 produced by changing part of the CH3 in one of the H chains of an antibody into an IgA-derived sequence corresponding to that portion, and introducing a corresponding IgA-derived sequence into the complementary portion of the CH3 on the other H chain (Protein Engineering Design & Selection, 23; 195-202, 2010). This known technology can also be used to efficiently induce association of polypeptides having different amino acids and comprising an Fc region.

In addition, one can also use technologies for heterodimerized antibody production using association of antibody CH1 and CL, and association of VH and VL, which are described in WO 2011/028952.

Furthermore, even in cases where heterodimerized polypeptides cannot be formed efficiently, heterodimerized polypeptides can be obtained by separating and purifying them from homodimerized polypeptides. When producing a heterodimerized polypeptide consisting of a first polypeptide and a second polypeptide which have different sequences from each other, homodimerized polypeptides consisting of only two first polypeptides, and homodimerized polypeptide consisting of only two second polypeptide are mixed in as impurities. Known technologies can be used as a method for efficiently removing these two types of homodimerized polypeptides. A method has been reported to be able to purify two types of homodimers and the heterodimerized antibody of interest by ion exchange chromatography, by creating a difference in isoelectric points by introducing amino acid substitutions into the variable regions of the two types of H chains (WO 2007114325).

Regarding amino acid alteration for conferring difference in isoelectric points, the amino acid alteration to be introduced is not particularly limited as long as a difference is produced between the isoelectric points of the two associating polypeptides, and it may also include amino acid alterations made for other purposes such as lowering immunogenicity. The altered amino acids are preferably amino acids at positions with little influence on the binding activity towards an Fcγ receptor. Furthermore, it may be an amino acid alteration that increases binding activity to a desired Fcγ receptor. For such alterations, it is preferable to introduce at least one amino acid mutation into an amino acid position selected from specifically the group consisting of Gly at position 137, Gly at position 138, Thr at position 139, Lys at position 147, Ser at position 192, Leu at position 193, Gln at position 196, Tyr at position 198, Ile at position 199, Asn at position 203, Lys at position 214, Ala at position 231, Glu at position 233, Leu at position 242, Val at position 263, Glu at position 272, Lys at position 274, Tyr at position 278, Lys at position 288, Lys at position 290, Gly at position 316, Lys at position 317, Lys at position 320, Lys at position 324, Thr at position 335, Ser at position 337, Lys at position 338, Lys at position 340, Gly at position 341, Leu at position 358, Lys at position 360, Gln at position 362, Ser at position 364, Ser at position 383, Asn at position 384, Gly at position 385, Gln at position 386, Pro at position 387, Asn at position 390, Val at position 397, and Val at position 422 (EU numbering) in the amino acid sequence of the first polypeptide and/or the second polypeptide. Furthermore, it is preferable to introduce a mutation into at least one amino acid selected from the group consisting of Gly at position 137, Gly at position 138, Thr at position 139, Lys at position 147, Ser at position 192, Leu at position 193, Gln at position 196, Ile at position 199, Asn at position 203, Lys at position 214, Glu at position 272, Lys at position 274, Lys at position 288, Lys at position 290, Leu at position 358, Lys at position 360, Gln at position 362, Ser at position 383, Asn at position 384, Gly at position 385, Gln at position 386, Asn at position 390, Val at position 397, and Val at position 422 (EU numbering). Further, it is more preferable to introduce a mutation into at least one amino acid selected from the group consisting of Gly at position 137, Gly at position 138, Lys at position 147, Ser at position 192, Leu at position 193, Gln at position 196, Ile at position 199, Asn at position 203, Lys at position 214, Lys at position 274, Lys at position 288, Leu at position 358, Asn at position 384, and Val at position 397 (EU numbering).

More specifically, it is preferable that a mutation is introduced into at least one amino acid selected from the group consisting of Gln at position 196, Ile at position 199, Ala at position 231, Glu at position 233, Leu at position 242, Val at position 263, Glu at position 272, Gly at position 316, Leu at position 358, Ser at position 364, Ser at position 383, Pro at position 387, and Val at position 397 (EU numbering) in the amino acid sequence of either polypeptide of the first polypeptide and the second polypeptide; and preferably a mutation is introduced into at least one amino acid selected from the group consisting of Gly at position 137, Gly at position 138, Thr at position 139, Lys at position 147, Ser at position 192, Leu at position 193, Tyr at position 198, Ile at position 199, Asn at position 203, Lys at position 214, Lys at position 274, Tyr at position 278, Lys at position 288, Lys at position 290, Gly at position 316, Lys at position 317, Lys at position 320, Lys at position 324, Thr at position 335, Ser at position 337, Lys at position 338, Lys at position 340, Gly at position 341, Leu at position 358, Lys at position 360, Gln at position 362, Ser at position 383, Asn at position 384, Gly at position 385, Gln at position 386, Asn at position 390, and Val at position 422 (EU numbering) in the amino acid sequence of the other polypeptide. Furthermore, it is preferable that a mutation is introduced into at least one amino acid selected from the group consisting of Gln at position 196, Ile at position 199, Glu at position 272, Leu at position 358, Ser at position 383, and Val at position 397 (EU numbering) in the amino acid sequence of one of the polypeptides; and preferably a mutation is introduced into at least one amino acid selected from the group consisting of Gly at position 137, Gly at position 138, Thr at position 139, Lys at position 147, Ser at position 192, Leu at position 193, Ile at position 199, Asn at position 203, Lys at position 214, Lys at position 274, Lys at position 288, Lys at position 290, Leu at position 358, Lys at position 360, Gln at position 362, Ser at position 383, Asn at position 384, Gly at position 385, Gln at position 386, Asn at position 390, and Val at position 422 (EU numbering) in the amino acid sequence of the other polypeptide. Furthermore, it is more preferable that a mutation is introduced into at least one amino acid selected from the group consisting of Gln at position 196, Ile at position 199, Leu at position 358, and Val at position 397 (EU numbering) in the amino acid sequence of one of the polypeptides; and that a mutation is introduced into at least one amino acid selected from the group consisting of Gly at position 137, Gly at position 138, Lys at position 147, Ser at position 192, Leu at position 193, Ile at position 199, Asn at position 203, Lys at position 214, Lys at position 274, Lys at position 288, and Asn at position 384 (EU numbering) in the amino acid sequence of the other polypeptide.

The amino acid alteration is not particularly limited as long as the alteration is made to produce a difference in isoelectric points between the two associating polypeptides after the alteration.

Examples of a preferred alteration for increasing the isoelectric point include substitution of the amino acid at position 196 with Lys, substitution of the amino acid at position 231 with Lys, substitution of the amino acid at position 242 with Lys, substitution of the amino acid at position 263 with Lys, substitution of the amino acid at position 272 with Lys, substitution of the amino acid at position 316 with Lys, substitution of the amino acid at position 364 with Lys, substitution of the amino acid at position 358 with Lys, substitution of the amino acid at position 383 with Lys, substitution of the amino acid at position 387 with Lys, and substitution of the amino acid at position 397 with Lys (EU numbering). Examples of a preferred alteration for decreasing the isoelectric point include substitution of the amino acid at position 137 with Glu, substitution of the amino acid at position 138 with Glu, substitution of the amino acid at position 139 with Glu, substitution of the amino acid at position 147 with Glu, substitution of the amino acid at position 198 with Glu, substitution of the amino acid at position 203 with Asp, substitution of the amino acid at position 214 with Thr, substitution of the amino acid at position 274 with Gln, substitution of the amino acid at position 278 with Glu, substitution of the amino acid at position 288 with Glu, substitution of the amino acid at position 290 with Glu, substitution of the amino acid at position 316 with Glu, substitution of the amino acid at position 317 with Glu, substitution of the amino acid at position 320 with Glu, substitution of the amino acid at position 324 with Glu, substitution of the amino acid at position 335 with Glu, substitution of the amino acid at position 337 with Asp, substitution of the amino acid as position 338 with Glu, substitution of the amino acid at position 340 with Glu, substitution of the amino acid at position 341 with Glu, substitution of the amino acid at position 358 with Glu, substitution of the amino acid at position 360 with Glu, substitution of the amino acid at position 362 with Glu, substitution of the amino acid at position 383 with Glu, substitution of the amino acid at position 384 with Glu, substitution of the amino acid at position 385 with Glu, substitution of the amino acid at position 386 with Glu, substitution of the amino acid at position 390 with Glu, and substitution of the amino acid at position 422 with Glu (EU numbering).

When combining amino acid alterations that are made for a purpose other than producing a difference in isoelectric points, for example, to lower antigenicity, substitution of the amino acid at position 138 with Ser, substitution of the amino acid at position 192 with Asn, substitution of the amino acid at position 193 with Phe, and substitution of the amino acid at position 199 with Thr (EU numbering) may be combined.

Here, "reduced immunogenicity" means that an antibody does not evoke the production of antibodies in sufficient quantity to reduce the continued efficacy of antibody administration in at least the majority of individuals receiving the antibody for a sufficient amount of time to achieve therapeutic efficacy.

The level of immunogenicity in humans may be predicted using the MHC class II binding prediction program Propred (http://www.imtech.res.in/raghava/propred) with 1% threshold value analysis of all alleles. Other programs which can be used include:

Rankpep (http://bio.dfci.harvard.edu/Tools/rankpep.html); and

Epibase (Algonomics proprietary software: algonomics.com).

Compared to the starting donor molecule, polypeptides with reduced immunogenicity contain no peptides that are predicted to bind to highly expressed MHC class II alleles in the target population or a reduced number of the peptides (Flower et al. (Drug Discov Today (2004) 9(2): 82-90)).

Functional analysis of MHC class II binding can be performed by generating overlapping peptides that correspond to the protein of interest, and testing their ability to evoke T cell activation (T cell proliferation assay) or replacing the peptides with a known MHC class II-binding peptide as a reporter peptide (Hammer et al. (J. Exp. Med. (1994) 180: 2353-2358).

So far, as a method for purifying a heterodimerized antibody, a method that uses protein A for purifying a heterodimerized antibody comprising a mouse IgG2a H chain that binds to protein A and a rat IgG2b H chain that does not bind to protein A has been reported (WO 98050431 and WO 95033844).

Furthermore, a heterodimerized antibody alone can be efficiently purified by using H chains in which the amino acid residues at positions 435 and 436 (EU numbering), which are the binding site between IgG and Protein A, are substituted with amino acids such as Tyr and His which have different affinity to Protein A to change the interaction between each of the H chains and Protein A, and by using a Protein A column. A plurality, for example, two or more, of these substitutions and technologies can be used in combination. Furthermore, when appropriate, these alterations can be applied separately to the first polypeptide and the second polypeptide. Polypeptides of the present invention may be those produced based on the polypeptides to which the above-mentioned alterations have been applied.

The present invention also provides a method for producing a polypeptide comprising an Fc region, which comprises the steps of heterodimerizing the Fc region by introducing an amino acid mutation into the first polypeptide and/or the second polypeptide constituting the Fc region, and introducing an amino acid mutation to alter the Fc region function compared to when the Fc region forms a homodimer.

Examples include a production method comprising the following steps of:
(a) in a polypeptide comprising an Fc region, introducing an amino acid mutation into the first polypeptide and/or the second polypeptide constituting the Fc region;
(b) determining the Fc region function of the heterodimer consisting of the first polypeptide and second polypeptide into which a mutation is introduced in step (a); and
(c) selecting a polypeptide with altered Fc region function compared to the parent polypeptide or compared to when the Fc region is homodimerized by introduction of the amino acid mutation.

In this production method, the following step may be performed after step (a):
(d) displaying the Fc region-containing heterodimerized polypeptide consisting of the first polypeptide and the second polypeptide on the presented ribosomes, phages, or yeast.

A preferred embodiment is a method for producing a polypeptide comprising an Fc region which comprises the steps of:
(a) altering a nucleic acid encoding the polypeptide so that the Fc region function is altered compared to the parent polypeptide or compared to when the Fc region forms a homodimer by introduction of amino acid mutation;
(b) introducing the nucleic acid into a host cell and culturing the cell to express the polypeptide; and
(c) collecting the polypeptide from a host cell culture.

Antibodies and Fc fusion protein molecules produced by the production method are also included in the present invention.

The type and range of amino acid mutations introduced by the present method are not particularly limited, but examples include amino acid mutations involved in alteration of each Fc region function described herein (more specifically, amino acid mutations disclosed specifically in the Tables in the Examples).

The present invention also provides a method for altering the function of a polypeptide comprising an Fc region, which comprises the steps of heterodimerizing the Fc region by introducing an amino acid mutation into the first polypeptide and/or the second polypeptide constituting the Fc region to alter the Fc region function compared to when the Fc region forms a homodimer by introduction of the amino acid mutation.

Examples include alteration methods comprising the following steps of:
(a) in a polypeptide comprising an Fc region, introducing an amino acid mutation into the first polypeptide and/or the second polypeptide constituting the Fc region;
(b) determining the Fc region function of the heterodimer consisting of the first polypeptide and second polypeptide into which a mutation is introduced in step (a); and
(c) selecting a polypeptide with altered Fc region function compared to the parent polypeptide or compared to when the Fc region is homodimerized by introduction of the amino acid mutation.

In this alteration method, the following step may be performed after step (a):
(d) displaying the Fc region-containing heterodimerized polypeptide consisting of the first polypeptide and the second polypeptide presented on ribosomes, phages, or yeast.

A preferred embodiment is a method for altering a polypeptide comprising an Fc region which comprises the steps of:
(a) altering a nucleic acid encoding the polypeptide so that the Fc region function is altered compared to the parent polypeptide or compared to when the Fc region forms a homodimer by introduction of the amino acid mutation;
(b) introducing the nucleic acid into a host cell and culturing the cell to express the polypeptide; and
(c) collecting the polypeptide from a host cell culture.

Antibodies and Fc fusion protein molecules altered by the alteration method are also included in the present invention.

The type and range of amino acid mutations introduced by the present method are not particularly limited, but examples include amino acid mutations involved in alteration of each Fc region function described herein (more specifically, amino acid mutations disclosed specifically in the Tables in the Examples).

Furthermore, the present invention provides nucleic acids that encode polypeptides which are characterized in being composed of a heterodimer comprising a first polypeptide and a second polypeptide, wherein the first polypeptide and the second polypeptide comprise an Fc region introduced with mutations, wherein the function of the Fc region is altered compared to a polypeptide comprising an Fc region that has not been introduced with mutations. The nucleic acids of the present invention may be in any form such as DNA or RNA.

The present invention also provides vectors carrying the above-described nucleic acids of the present invention. The type of vector can be appropriately selected by those skilled in the art depending on the host cells to be introduced with the vector. The vectors include, for example, those described above.

Furthermore, the present invention relates to host cells transformed with the above-described vectors of the present invention. Appropriate host cells can be selected by those skilled in the art. The host cells include, for example, those described above.

<Pharmaceutical Compositions>

The present invention provides pharmaceutical compositions comprising the polypeptide of the present invention.

The pharmaceutical compositions of the present invention can be formulated, in addition to the antibodies or Fc-fusion protein molecules, which are the polypeptides of the present invention, with pharmaceutically acceptable carriers by known methods. For example, the compositions can be used parenterally, when the antibodies or Fc-fusion protein molecules are formulated in a sterile solution or suspension for injection using water or any other pharmaceutically acceptable liquid. For example, the compositions can be formulated by appropriately combining the antibodies or Fc-fusion protein molecules with pharmacologically acceptable carriers or media, specifically, sterile water or physiological saline, vegetable oils, emulsifiers, suspending agents, surfactants, stabilizers, flavoring agents, excipients, vehicles, preservatives, binding agents, and such, by mixing them at a unit dose and form required by generally accepted pharmaceutical implementations. Specific examples of the carriers include light anhydrous silicic acid, lactose, crystalline cellulose, mannitol, starch, carmellose calcium, carmellose sodium, hydroxypropyl cellulose, hydroxypropyl methylcellulose, polyvinylacetal diethylaminoacetate, polyvinylpyrrolidone, gelatin, medium-chain triglyceride, polyoxyethylene hardened castor oil 60, saccharose, carboxymethyl cellulose, corn starch, inorganic salt, and such. The content of the active ingredient in such a formulation is adjusted so that an appropriate dose within the required range can be obtained.

Sterile compositions for injection can be formulated using vehicles such as distilled water for injection, according to standard protocols.

Aqueous solutions used for injection include, for example, physiological saline and isotonic solutions containing glucose or other adjuvants such as D-sorbitol, D-mannose, D-mannitol, and sodium chloride. These can be used in conjunction with suitable solubilizers such as alcohol, specifically ethanol, polyalcohols such as propylene glycol and polyethylene glycol, and non-ionic surfactants such as Polysorbate 80™ and HCO-50.

Oils include sesame oils and soybean oils, and can be combined with solubilizers such as benzyl benzoate or benzyl alcohol. These may also be formulated with buffers, for example, phosphate buffers or sodium acetate buffers; analgesics, for example, procaine hydrochloride; stabilizers, for example, benzyl alcohol or phenol; or antioxidants. The prepared injections are typically aliquoted into appropriate ampules.

The administration is preferably carried out parenterally, and specifically includes injection, intranasal administration, intrapulmonary administration, and percutaneous administration. For example, injections can be administered systemically or locally by intravenous injection, intramuscular injection, intraperitoneal injection, or subcutaneous injection.

Furthermore, the method of administration can be appropriately selected according to the age and symptoms of the patient. A single dosage of the pharmaceutical composition containing a polypeptide or a polynucleotide encoding a polypeptide can be selected, for example, from the range of 0.0001 to 1,000 mg per kg of body weight. Alternatively, the dosage may be, for example, in the range of 0.001 to 100,000 mg/patient. However, the dosage is not limited to these values. The dosage and method of administration vary depending on the patient's body weight, age, and symptoms, and can be appropriately selected by those skilled in the art.

In the present invention, the pharmaceutical compositions comprising the polypeptides of the present invention described above are useful as active ingredients for therapeutic agents or preventive agents for cancer, immune inflammatory diseases, and such.

As used herein, the three-letter and single-letter codes for respective amino acids are as follows:

Alanine: Ala (A)
Arginine: Arg (R)
Asparagine: Asn (N)
Aspartic acid: Asp (D)
Cysteine: Cys (C)
Glutamine: Gln (Q)
Glutamic acid: Glu (E)
Glycine: Gly (G)
Histidine: His (H)
Isoleucine: Ile (I)
Leucine: Leu (L)
Lysine: Lys (K)
Methionine: Met (M)
Phenylalanine: Phe (F)
Proline: Pro (P)
Serine: Ser (S)
Threonine: Thr (T)
Tryptophan: Trp (W)
Tyrosine: Tyr (Y)
Valine: Val (V)

All prior art documents cited herein are incorporated by reference in their entirety.

EXAMPLES

Herein below, the present invention will be specifically described further with reference to the Examples, but it is not to be construed as being limited thereto.

Figure 1:
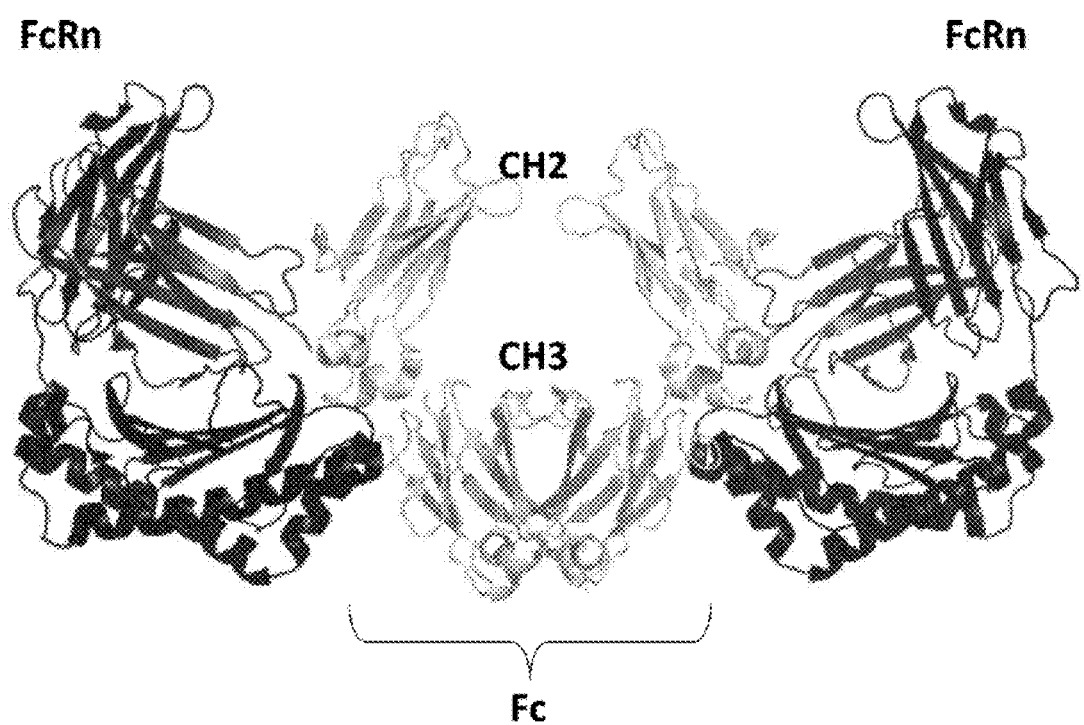
FIG. 1 shows the structure of a complex of Fc region and FcRn. FcRn binds to CH2 and CH3 of each antibody H chain, and is bound to the whole antibody in a symmetric fashion.
Figure 2:
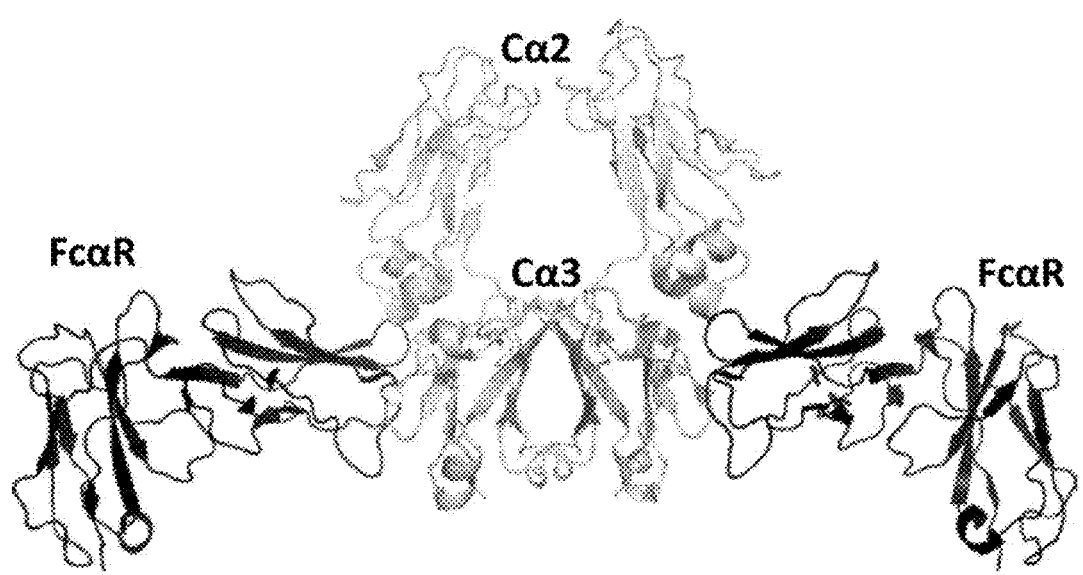
FIG. 2 shows the structure of a complex of IgA and FcαR which is an IgA receptor. FcαR binds to Cα2 and Cα3 of each IgA H chain, and is bound to the whole antibody in a symmetric fashion.

[Example 1] Explanation of the Concept of the Improvement of FcγR Recognition by Heterodimerized Antibodies An antibody interacts via its Fc region with various molecules such as FcRn, FcγR, and complements. A single molecule of FcRn, which is a ligand of Fc, binds to each one of the heavy chains (H chains) of an antibody. Thus, two molecules of FcRn bind to a single antibody molecule (FIG. 1). In vivo, FcRn is expressed on the cell membrane. Thus, an antibody recognizes two molecules of FcRn in a symmetrical manner via the identical sites in its respective H chains in vivo (Nature, 372: 379-383, 1994). Furthermore, in a manner similar to the relationship between IgG and FcRn, a single molecule of IgA, which belongs to the same immunoglobulin family as IgG, recognizes in a symmetrical manner two molecules of FcαR, which is an IgA receptor (FIG. 2) (Nature, 423: 614-620, 2003).

Figure 3:
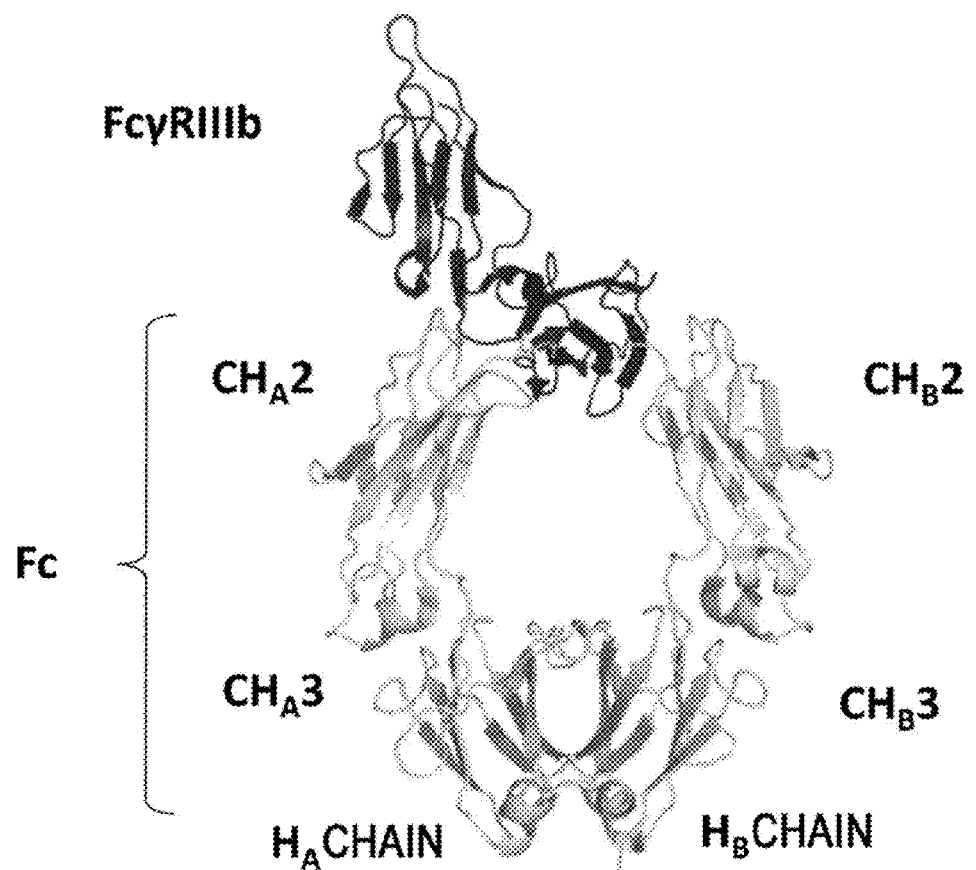
FIG. 3 shows the structure of a complex of Fc region and FcγRIII. For the H chain, CH2, and CH3, those on the left side of the figure are referred to as the $H_A$ chain, $CH_A2$, and $CH_A3$, and those on the right side are referred to as the $H_B$ chain, $CH_B2$, and $CH_B3$, respectively.
Figure 4:
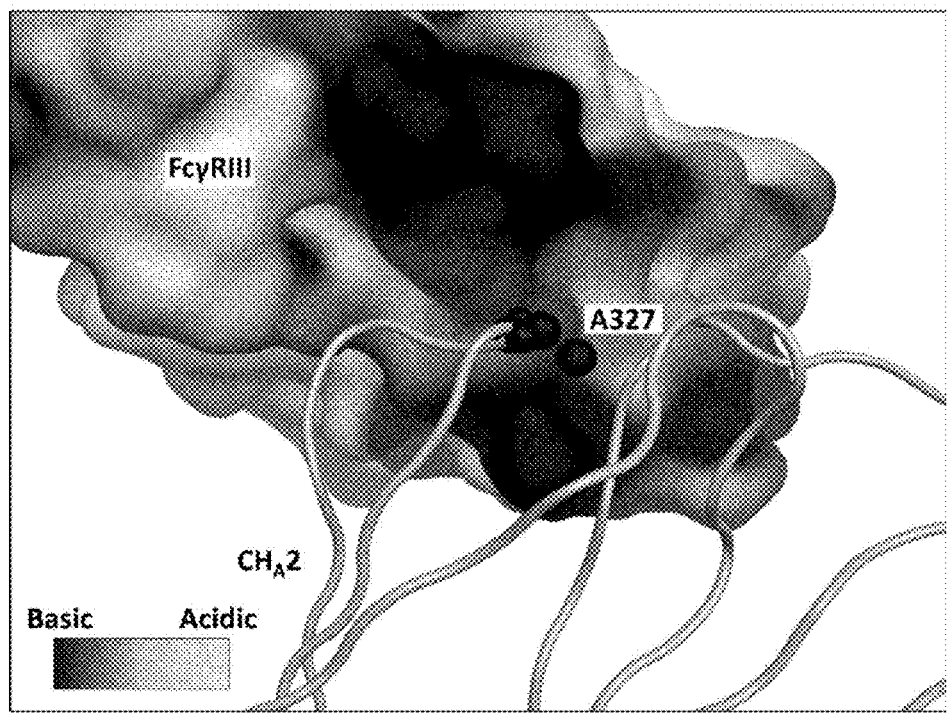
FIG. 4 shows detailed interactions between A327 in each H chain and FcγRIII. (A) shows the interaction between A327 in $CH_A2$ and FcγRIII. (B) shows the interaction between A327 in $CH_B2H_B$ and FcγRIII. In FcγRIII, the colors black, grey, and white indicate the basic portion, neutral portion, and acidic portion, respectively.
Figure 4:
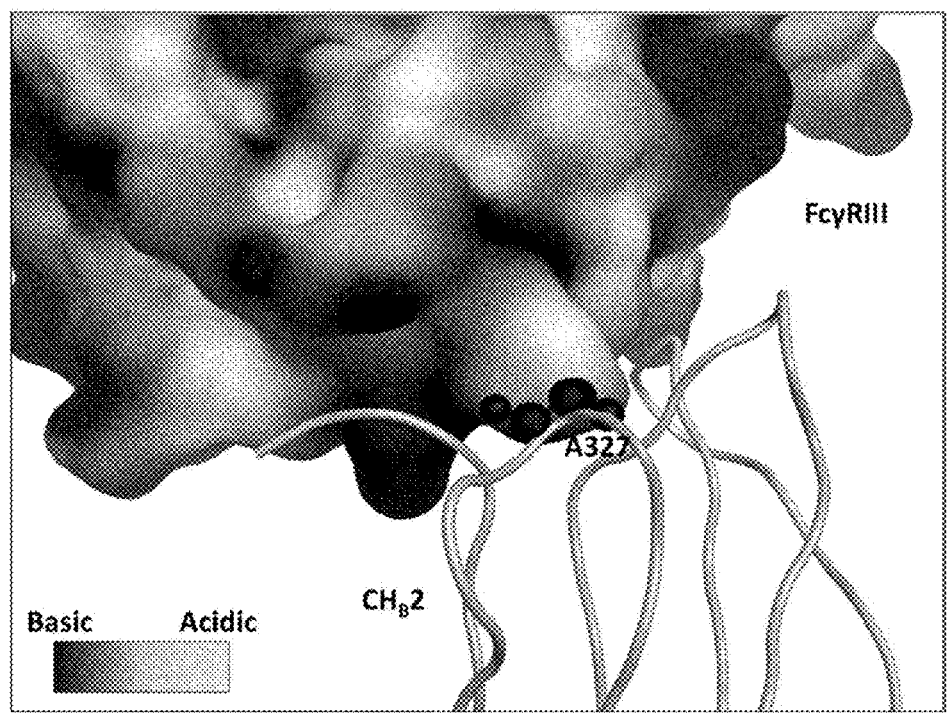

However, unlike FcRn and others, only one molecule of FcγR binds to one molecule of an antibody (FIG. 3) (JBC, 276: 16469-16477, 2001). IgG recognizes FcγR via the CH2 domains of the two H chains; however, the FcγR-interaction sites are different between the two H chains. For example, when the H chain shown at the left side of FIG. 3 is defined as $H_A$ chain, and the one at the right side as $H_B$ chain, Ala at position 327 (EU numbering) in each of the $H_A$ and HB chains interacts with FcγR. However, there is a difference between the properties of the partner residues with which the respective H chains interact (FIG. 4). The $H_A$ chain interacts with FcγRIII in a hydrophobic manner at Trp of positions 87 and 110 (EU numbering), while the HB chain interacts with FcγRIII at His of position 131 (EU numbering). Hence, when Ala at position 327 (EU numbering) is substituted with a highly-hydrophobic amino acid such as Trp, it can reduce the FcγR-binding activity of $H_B$ chain even if it has the effect of improving the FcγR-binding activity of $H_A$ chain. Thus, the asymmetric effect of the two H chains on FcγR needs to be considered to optimize the interaction of the Fc region of IgG with FcγR by amino acid alteration. Nevertheless, in the prior art, the same alteration has been introduced into the two H chains to optimize the interaction of the Fc region of IgG with FcγR (WO 2006/019447 and WO 2000/042072). However, when considering the asymmetric interaction the Fc region of IgG with FcγR, the interaction between IgG and FcγR can be optimized more finely by introducing different alterations into the H chains. That is, the interaction with FcγR can be more finely optimized by using a heterodimerized antibody resulting from the introduction of different alterations into the two H chains to optimize the interaction of the Fc region with FcγR as compared to a homodimerized antibody resulting from the introduction of the same alteration into the H chains, which has been performed in the prior art.

[Example 2] Proof of the Concept of the Improvement of FcγR Recognition by Heterodimerized Antibodies It was assessed whether the FcγR-binding activity of an antibody can be optimized more finely by using a heterodimerized antibody introduced with different alterations into the two H chains as compared to a homodimerized antibody of the prior art.

Conventionally, alterations that enhance the FcγR binding have been sought by using a homodimerized antibody resulting from the introduction of the same alteration into both H chains of an antibody. However, as described in Example 1, an antibody interacts with FcγR in an asymmetric manner, and when the same alteration is introduced into the two H chains, the alteration in one H chain could enhance the FcγR-binding activity while the alteration in the other H chain could rather inhibit the binding. The FcγR-binding activity is not necessarily increased in a homodimerized antibody resulting from the introduction of such an alteration into both H chains. However, a heterodimerized antibody resulting from the introduction of the alteration into only one of the two H chains can have increased FcγR-binding activity.

In order to test this hypothesis, with respect to FcγR binding, a heterodimerized antibody comprising a first polypeptide in which only one H chain has been introduced with an alteration that is thought to alter the FcγR-binding activity and a second polypeptide without the above alteration was compared with a homodimerized antibody comprising the first polypeptide in which only one H chain has been introduced with the alteration that is thought to alter the FcγR-binding activity. Based on the previous concept, when the FcγR-binding activity is increased by the alteration, the homodimerized antibody is always superior to the heterodimerized antibody. However, if an antibody Fc recognizes FcγR in an asymmetric manner, the heterodimerized antibody is expected to show greater FcγR-binding activity than the homodimerized antibody depending on the type of alteration.

The H chain variable region of an antibody used was the variable region of an anti-glypican-3 antibody which contains CDR of pH7 of the anti-glypican-3 antibody with improved kinetics in plasma disclosed in WO 2009/041062. The variable region is named GpH7 (SEQ ID NO: 1). The constant regions of antibody H chains described below were used in combination with GpH7. When the H chain constant region of an antibody is named H1, the sequence of the antibody H chain having the variable region GpH7 is referred to as GpH7-H1 Amino acid alterations are indicated in a manner such as D356K. The first alphabetical letter (for example, "D" of D356K) is a one-letter code representing the amino acid residue before alteration, and the following numeral (for example, "356" of D356K) indicates the position of alteration (EU numbering). The last alphabetical letter (for example, "K" of D356K) is a one-letter code representing the amino acid residue after alteration. GpH7-G1d (SEQ ID NO: 2) resulting from the removal of the C-terminal Gly and Lys from an IgG1 having the variable region GpH7; GpH7-A5 (SEQ ID NO: 3) resulting from the introduction of mutations D356K and H435R into GpH7-G1d; and GpH7-B3 (SEQ ID NO: 4) resulting from the introduction of K439E into GpH7-G1d were prepared according to the method described in Reference Example 1. The mutations D356K and K439E were introduced into each H chain to allow effective formation of heterodimer of the respective H chains when producing a heterodimerized antibody comprising two types of H chains (WO 2006/106905). H435R, which is an alteration that inhibits Protein A binding, was introduced to allow efficient separation of the heterodimerized and homodimerized forms (see Reference Examples 3, 4, and 5). Meanwhile, the antibody L chain used was GpL16-k0 (SEQ ID NO: 5), which is the L chain of the glypican-3 antibody with improved kinetics in plasma disclosed in WO 2009/041062.

Mutations for proving the concept of the heterodimerized antibody were introduced into parental polypeptides GpH7-A5 and GpH7-B3 to construct modified variants, and the variants were assessed. The constructed expression vectors were used to transfect FreeStyle293 cells (Invitrogen) according to the method described in Reference Example 1. The expressed antibodies were purified according to the method described in Reference Example 1. When expressing a homodimerized antibody, an expression vector inserted with the antibody L chain GpL16-k0 was used together with an expression vector inserted with one type of antibody H chain sequence. When a heterodimerized antibody was expressed, an expression vector inserted with the antibody L chain GpL16-k0, as used for the above homodimerized antibody, and an expression vector inserted with a sequence resulting from the introduction of an additional alteration into GpH7-A5 having the alteration D356K as one antibody H chain, and an expression vector inserted with a sequence resulting from the introduction of an additional alteration into GpH7-B3 having the alteration K439E as the other antibody H chain, were used to achieve efficient expression of the heterodimerized antibody. The antibody expressed and purified is referred to, for example, as GpH7-H1/GpH7-H2/GpL16-k0, when the expression vector used to express one antibody H chain of the heterodimerized antibody is GpH7-H1, the expression vector for the other antibody H chain is GpH7-H2, and the expression vector for the antibody L chain is GpL16-k0. In this system, a sequence introduced with the alterations D356K and H435R corresponds to H1, and a sequence introduced with the alteration K439E corresponds to H2. For example, when the expression vectors used to express the antibody H chain and L chain of a homodimerized antibody are respectively GpH7-H1 and GpL16-k0, the homodimerized antibody is referred to as GpH7-H1/GpL16-k0. Prepared antibodies were used to measure the FcγR-binding activity by the method described in Reference Example 2.

Figure 5:
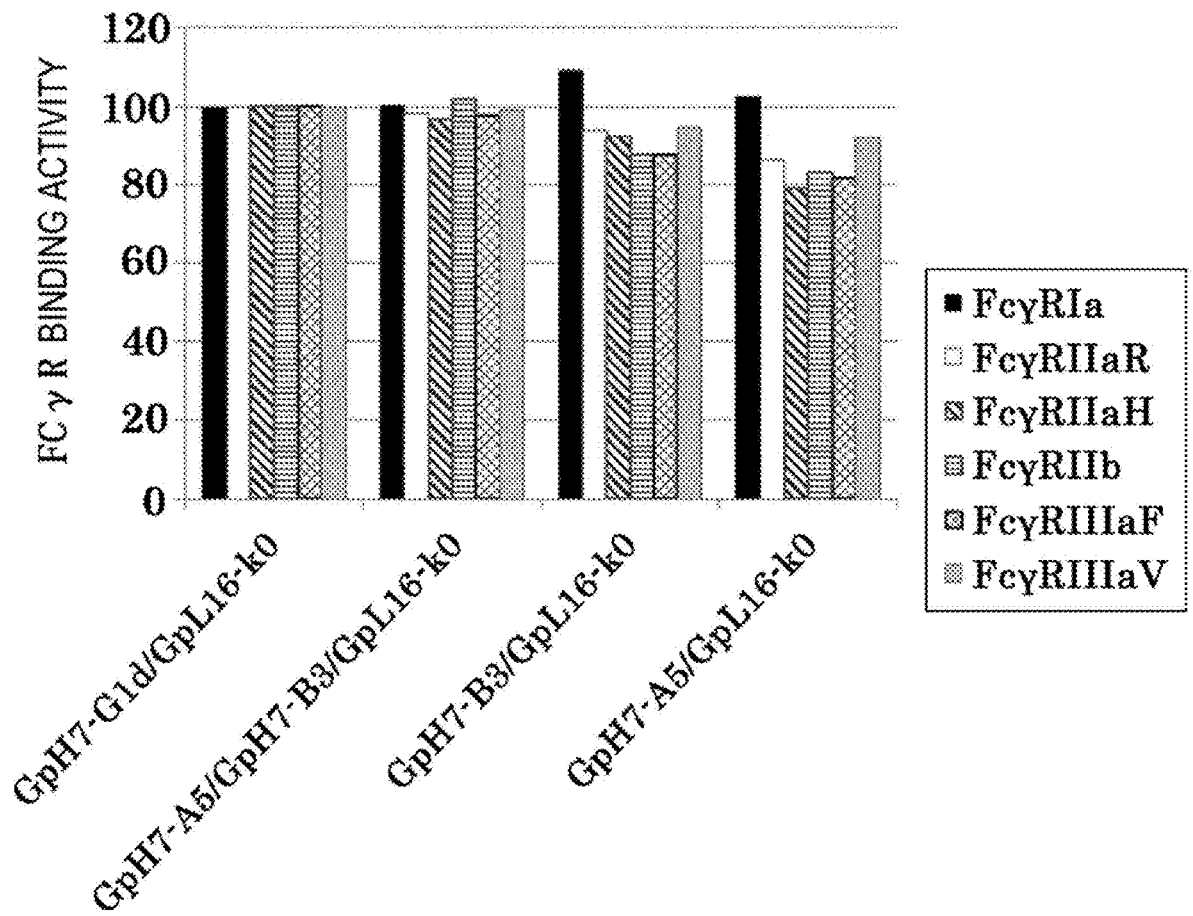
FIG. 5 shows comparison of FcγR-binding activities of antibodies into which D356K, H435R, and/or K439E have been introduced. The binding activity of GpH7-G1d/GpL16-k0 (SEQ ID NOs: 2 and 5) to each FcγR was defined as 100. The samples used for the evaluation and their sequences were GpH7-G1d/GpL16-k0 (SEQ ID NOs: 2 and 5), GpH7-A5/GpH7-B3/GpL16-k0 (SEQ ID NOs: 3, 4, and 5), GpH7-

First, it was assessed whether the alterations D356K and H435R introduced into GpH7-A5, and the alteration K439E introduced into GpH7-B3 to form and purify heterodimers had an effect on the FcγR-binding activity as compared to native IgG. As a control, GpH7-G1d/GpL16-k0 (SEQ ID NOs: 2 and 5, respectively) was expressed using plasmids inserted with GpH7-G1d and GpL16-k0 as the antibody H chain and L chain, respectively, and purified according to the method of Reference Example 1. Likewise, the homodimerized antibody GpH7-A5/GpL16-k0 (SEQ ID NOs: 3 and 5, respectively) whose two H chains were introduced with D356K and H435R, the homodimerized antibody GpH7-B3/GpL16-k0 (SEQ ID NOs: 4 and 5, respectively) whose two H chains were introduced with K439E, and the heterodimerized antibody GpH7-A5/GpH7-B3/GpL16-k0 (SEQ ID NOs: 3, 4, and 5, respectively) in which one of the H chains was introduced with D356K and H435R and the other was introduced with K439E, were prepared. These antibodies and their binding activity to each FcγR were compared according to the method described in Reference Example 2, and the result is summarized in FIG. 5.

The measurement result showed that there was no significant difference in the binding activity to each FcγR between GpH7-G1d/GpL16-k0 and GpH7-A5/GpH7-B3/GpL16-k0. Furthermore, with respect to each FcγR, GpH7-A5/GpL16-k0 and GpH7-B3/GpL16-k0 retained at least about 80% of the binding activity of GpH7-G1d/GpL16-k0. Based on the above result, it was determined that the FcγR binding of GpH7-A5/GpH7-B3/GpL16-k0, GpH7-A5/GpL16-k0, and GpH7-B3/GpL16-k0 was not significantly reduced as compared to GpH7-G1d/GpL16-k0, and thus, variants resulting from the introduction of mutations into each H chain of these antibodies can be compared for the binding activity to each FcγR.

Then, GpH7-A26 (SEQ ID NO: 6) resulting from the introduction of mutation G237A into GpH7-A5 was constructed according to the method described in Reference Example 1. Using GpL16-k0 as the L chain, and GpH7-A26 and GpH7-B3 as the H chain, the heterodimerized antibody GpH7-A26/GpH7-B3/GpL16-k0 (SEQ ID NOs: 6, 4, and 5, respectively) in which only one of the H chains has been introduced with G237A was expressed according to the method described in Reference Example 1. Likewise, using GpH7-A26 as the H chain and GpL16-k0 as the L chain, the homodimerized antibody GpH7-A26/GpL16-k0 (SEQ ID NOs: 6 and 5, respectively) whose two H chains were introduced with G237A was expressed according to the method described in Reference Example 1. These antibodies were assessed for the binding activity to each FcγR according to the method described in Reference Example 2 (FIG. 6). The result showed that the heterodimerized antibody GpH7-A26/GpH7-B3/GpL16-k0 had increased binding activities to FcγRIIa R and FcγRIIb as compared to GpH7-A5/GpH7-B3/GpL16-k0. Meanwhile, the homodimerized antibody GpH7-A26/GpL16-k0 in which the same alteration was introduced into both H chains had reduced binding activities to FcγRIIa R and FcγRIIb as compared to GpH7-A5/GpH7-B3/GpL16-k0. These results demonstrate that, G237A is an alteration that increases the binding activities to FcγRIIa R and FcγRIIb when introduced into only one H chain, while reduces the binding activities to FcγRIIa R and FcγRIIb when introduced into both H chains.

Then, GpH7-A29 (SEQ ID NO: 7) resulting from the introduction of the mutation G237L into GpH7-A5 was constructed according to the method described in Reference Example 1. Using GpL16-k0 as the L chain, and GpH7-A29 and GpH7-B3 as the H chain, the heterodimerized antibody GpH7-A29/GpH7-B3/GpL16-k0 (SEQ ID NOs: 7, 4, and 5, respectively) in which only one of the H chains has been introduced with G237L was expressed according to the method described in Reference Example 1. Likewise, using GpH7-A29 as the H chain and GpL16-k0 as the L chain, the homodimerized antibody GpH7-A29/GpL16-k0 (SEQ ID NOs: 7 and 5, respectively) whose two H chains were introduced with G237L was expressed according to the method described in Reference Example 1. These antibodies and their binding activities to each FcγR were assessed according to the method described in Reference Example 2 (FIG. 7). The heterodimerized antibody GpH7-A29/GpH7-B3/GpL16-k0 had increased FcγRIIa R-binding and FcγRIIb-binding activities as compared to GpH7-A5/GpH7-B3/GpL16-k0. Meanwhile, the homodimerized antibody GpH7-A29/GpL16-k0 whose two H chains had the same alteration had reduced binding activity to FcγRIIa R and FcγRIIb as compared to GpH7-A5/GpH7-B3/GpL16-k0. These results demonstrate that, G237L is an alteration that has an effect of increasing the binding activities to FcγRIIa R and FcγRIIb when introduced into only one H chain, while reducing the binding activities to FcγRIIa R and FcγRIIb when introduced into both H chains.

Then, GpH7-A42 (SEQ ID NO: 8) resulting from the introduction of the mutation L328E into GpH7-A5 was constructed according to the method described in Reference Example 1. Using GpL16-k0 as the L chain, and GpH7-A42 and GpH7-B3 as the H chain, the heterodimerized antibody GpH7-A42/GpH7-B3/GpL16-k0 (SEQ ID NOs: 8, 4, and 5, respectively) in which only one of the H chains has been introduced with L328E was expressed according to the method described in Reference Example 1. Likewise, using GpH7-A42 as the H chain and GpL16-k0 as the L chain, the homodimerized antibody GpH7-A42/GpL16-k0 (SEQ ID NO: 8 and 5, respectively) whose two H chains were introduced with L328E was expressed according to the method described in Reference Example 1. These antibodies were assessed for the binding activity to each FcγR according to the method described in Reference Example 2 (FIG. 8). The heterodimerized antibody GpH7-A42/GpH7-B3/GpL16-k0 had increased binding activity to FcγRIIa R and FcγRIIb as compared to GpH7-A5/GpH7-B3/GpL16-k0. Meanwhile, the homodimerized antibody GpH7-A42/GpL16-k0 whose two H chains were introduced with the same alteration had reduced FcγRIIa R-binding activity and increased FcγRIIb-binding activity as compared to GpH7-A5/GpH7-B3/GpL16-k0; however, the degree of increase was greater in GpH7-A42/GpH7-B3/GpL16-k0 in which only one of the H chains was introduced with L328E. These results demonstrate that L328E is an alteration that is more effective to increase the binding activities to FcγRIIa R and FcγRIIb when introduced into only one H chain than when introduced into both H chains.

Then, GpH7-A43 (SEQ ID NO: 9) resulting from the introduction of the mutation L328D into GpH7-A5 was constructed according to the method described in Reference Example 1. Using GpL16-k0 as the L chain, and GpH7-A43 and GpH7-B3 as the H chain, the heterodimerized antibody GpH7-A43/GpH7-B3/GpL16-k0 (SEQ ID NOs: 9, 4, and 5, respectively) in which only one of the H chains has been introduced with L328D was expressed according to the method described in Reference Example 1. Likewise, using GpH7-A43 as the H chain and GpL16-k0 as the L chain, the homodimerized antibody GpH7-A43/GpL16-k0 (SEQ ID NOs: 9 and 5, respectively) whose two H chains were introduced with L328D was expressed according to the method described in Reference Example 1. These antibodies were assessed for the binding activity to each FcγR according to the method described in Reference Example 2 (FIG. 9). The heterodimerized antibody GpH7-A43/GpH7-B3/GpL16-k0 had increased binding activity to FcγRIIa R and FcγRIIb as compared to GpH7-A5/GpH7-B3/GpL16-k0. Meanwhile, the homodimerized antibody GpH7-A43/GpL16-k0 whose two H chains were introduced with the same alteration had reduced FcγRIIa R-binding activity and increased FcγRIIb-binding activity as compared to GpH7-A5/GpH7-B3/GpL16-k0; however, the degree of increase was greater in GpH7-A43/GpH7-B3/GpL16-k0 in which only one of the H chains was introduced with L328D. These results demonstrate that L328D is an alteration that is more effective to increase the binding activities to FcγRIIa R and FcγRIIb when introduced into only one H chain than when introduced into both H chains.

Then, GpH7-B16 (SEQ ID NO: 10) resulting from the introduction of the mutation L234E into GpH7-B3 was constructed according to the method described in Reference Example 1. Using GpL16-k0 as the L chain, and GpH7-A5 and GpH7-B16 as the H chain, the heterodimerized antibody GpH7-A5/GpH7-B16/GpL16-k0 (SEQ ID NOs: 3, 10, and 5, respectively) in which only one of the H chains has been introduced with L234E was expressed according to the method described in Reference Example 1. Likewise, using GpH7-B16 as the H chain and GpL16-k0 as the L chain, the homodimerized antibody GpH7-B16/GpL16-k0 (SEQ ID NOs: 10 and 5, respectively) whose two H chains were introduced with L234E was expressed according to the method described in Reference Example 1. These antibodies were assessed for the binding activity to each FcγR according to the method described in Reference Example 2 (FIG. 10). The heterodimerized antibody GpH7-A5/GpH7-B16/GpL16-k0 had increased binding activities to FcγRIIIa F and FcγRIIb as compared to GpH7-A5/GpH7-B3/GpL16-k0. Meanwhile, the homodimerized antibody GpH7-B16/GpL16-k0 whose two H chains were introduced with the same alteration had reduced binding activities to FcγRIIIa F and FcγRIIb as compared to GpH7-A5/GpH7-B3/GpL16-k0. These results demonstrate that L234E is an alteration that is effective to increase the binding activities to FcγRIIIa F and FcγRIIb when introduced into only one H chain, while it reduces the binding activities to FcγRIIIa F and FcγRIIb when introduced into both H chains.

Then, GpH7-B17 (SEQ ID NO: 11) resulting from the introduction of the mutation L234D into GpH7-B3 was constructed according to the method described in Reference Example 1. Using GGpL16-k0 as the L chain, and GpH7-A5 and GpH7-B17 as the H chain, the heterodimerized antibody GpH7-A5/GpH7-B17/GpL16-k0 (SEQ ID NOs: 3, 11, and 5, respectively) whose two H chains were introduced with L234D was expressed according to the method described in Reference Example 1. Likewise, using GpH7-B17 as the H chain and GpL16-k0 as the L chain, the homodimerized antibody GpH7-B17/GpL16-k0 (SEQ ID NOs: 11 and 5, respectively) whose two H chains were introduced with L234D was expressed according to the method described in Reference Example 1. These antibodies were assessed for the binding activity to each FcγR according to the method described in Reference Example 2 (FIG. 11). The heterodimerized antibody GpH7-A5/GpH7-B17/GpL16-k0 had increased binding activity to FcγRIIa R and FcγRIIb as compared to GpH7-A5/GpH7-B3/GpL16-k0. Meanwhile, the homodimerized antibody GpH7-B17/GpL16-k0 whose two H chains were introduced with the same alteration had reduced binding activities to FcγRIIa R and FcγRIIb as compared to GpH7-A5/GpH7-B3/GpL16-k0. These results demonstrate that L234D is an alteration that is effective to increase the binding activities to FcγRIIa R and FcγRIIb when introduced into only one H chain, while it reduces the binding activities to FcγRIIa R and FcγRIIb when introduced into both H chains.

The above findings demonstrate that, even if a homodimerized antibody whose two H chains have been introduced with the same alteration exhibits reduced FcγR-binding activity, it is possible to increase the FcγR-binding activity by constructing a heterodimerized antibody in which only one of the H chains has been introduced with the alteration.

Thus, the above findings demonstrate that a superior FcγR-binding property of an antibody Fc domain can be provided by using a heterodimerized antibody whose two H chains have been introduced with different alterations, as compared to a homodimerized antibody made by a conventional method for introducing the same alteration into both H chains.

[Example 3] Confirmation of the Direction of FcγR Recognition of Heterodimerized Antibodies As shown in Example 2, it was demonstrated that, using heterodimerized antibodies, higher FcγR-binding activity compared to homodimerized antibodies can be achieved. When the alterations described in Example 2 were introduced into both H chains of an antibody, the FcγR-binding activity was rather reduced as compared to the naturally-occurring antibody. This finding suggests that such alteration results in an increase in the FcγR-binding activity when introduced into one H chain of a heterodimerized antibody; however, when the mutation is introduced into both H chains, upon binding to FcγR, the residue after alteration increases the binding in one chain, while inhibits the interaction with FcγR in the other chain. Herein, the state where FcγR is bound in the direction from the depth side of FIG. 3 is defined as "X-direction binding", while in an opposite manner, the binding from the front side is defined as "Y-direction binding". It was speculated that in the heterodimerized antibody only either of the X-direction and Y-direction of FcγR-binding activities is altered, whereas in the homodimerized antibody the FcγR-binding activities in X direction and Y direction are altered in the same manner.

To prove the hypothesis experimentally, the present inventors found alterations that mainly inhibit FcγR binding in only either of the X-direction and Y-direction, and introduced such alteration into either one of the H chains, and introduced into the same or the other H chain an alteration that enhances the FcγR-binding activity, to verify the inhibition of the FcγR-binding activity. The present inventors aimed to find a method to be used in combination with the above alteration. Conformational information was searched for alterations that are involved in the FcγR binding of an antibody but are only involved in the binding in only either one of the H chains. As a result, P329 was found as a candidate. P329 in the $H_A$ chain forms a hydrophobic core with Trp at positions 87 and 110 in FcγRIII, while P329 in the $H_B$ chain does not directly interact with FcγRIII (Nature, 372: 379-383, 1994) (FIG. 12). For example, it was thought that the substitution of P329 of the $H_A$ chain by an electrically charged residue causes collapse of the hydrophobic core, and results in inhibition of the X-direction binding shown in FIG. 12; however, it was predicted that there is no significant impact on the Y-direction binding, because P329 of the $H_B$ chain, which is not involved in the Y-direction binding on the other side, remains unsubstituted.

Mutations, electrically charged R, K, D, and E, were introduced into GpH7-B3 at P329 to respectively produce the sequences GpH7-B12, GpH7-B13, GpH7-B14, and GpH7-B15 (SEQ ID NOs: 12 to 15), and expression vectors inserted with these sequences were constructed by the method described in Reference Example 1. The constructed expression vectors were each combined with GpH7-A5 and GpL16-k0 to express heterodimerized antibodies, or they were combined with GpL16-k0 alone but not with other H chains to express homodimerized antibodies. These antibodies were expressed and purified according to the method described in Reference Example 1. The resulting purified antibodies are the following: the heterodimerized antibodies GpH7-A5/GpH7-B12/GpL16-k0, GpH7-A5/GpH7-B13/GpL16-k0, GpH7-A5/GpH7-B14/GpL16-k0, and GpH7-A5/GpH7-B15/GpL16-k0; and homodimerized antibodies GpH7-B12/GpL16-k0, GpH7-B13/GpL16-k0, GpH7-B14/GpL16-k0, and GpH7-B15/GpL16-k0. The prepared antibodies were used to assess the binding activity to each FcγR by the method described in Reference Example 2. The result is shown in FIG. 13.

The FcγR-binding activity of GpH7-A5/GpH7-B12/GpL16-k0 and GpH7-A5/GpH7-B13/GpL16-k0, which are heterodimerized antibodies introduced with P329R and P329K, respectively, was about ⅕ to ¼ of the binding activity to each FcγR of GpH7-A5/GpH7-B3/GpL16-k0. Meanwhile, the FcγR binding was not observed for the homodimerized antibodies GpH7-B12/GpL16-k0 and GpH7-B13/GpL16-k0. On the other hand, as to FcγRIa, the FcγR-binding activity of GpH7-A5/GpH7-B14/GpL16-k0 and GpH7-A5/GpH7-B15/GpL16-k0, which are the heterodimerized antibodies introduced with P329D and P329E, respectively, was about ⅕ to ¼ of the binding activity to each FcγR of GpH7-A5/GpH7-B3/GpL16-k0; as to FcγR other than FcγRIa, they retained 50% or more of the binding activity. The homodimerized antibodies GpH7-B14/GpL16-k0 and GpH7-B15/GpL16-k0 only retained the FcγRIa-binding activity, and the activity was ⅕ or less the FcγRIa-binding activity of GpH7-A5/GpH7-B3/GpL16-k0. GpH7-B12 and GpH7-B13 are introduced with basic residues, whereas GpH7-B14 and GpH7-B15 are introduced with acidic residues. Thus, it was thought that the FcγR-binding activity is more strongly inhibited by substituting P329 with a basic residue such as Arg and Lys. The result showing that the FcγR-binding activity was maintained when an alteration was introduced into only one H chain, while the binding was almost undetectable when the same alteration was introduced into both H chains, supports the hypothesis that the substitution of a hydrophilic residue for P329 in one H chain inhibits the binding in one direction although the binding in the other direction is retained.

Then, whether the mutations G237A and L234D that enhance the FcγR-binding activity by heterodimerization, which were found as described in Example 2, enhance the interaction with FcγR exclusively in one direction was assessed by comparing the binding activity to each FcγR of each variant which was prepared to have the alteration P329R in combination with the above alterations. Expression vectors inserted with GpH7-B12 (SEQ ID NO: 12) resulting from the introduction of the mutation P329R into GpH7-B3 such that P329R is introduced into the same H chain as K439E; GpH7-A48 (SEQ ID NO: 16) resulting from the introduction of the mutation P329R into GpH7-A5 such that P329R is introduced into the same H chain as D356K and H435R; GpH7-A45 (SEQ ID NO: 17) resulting from the introduction of the mutations G237A and P329R into GpH7-A5; and GpH7-B41 (SEQ ID NO: 18) resulting from the introduction of the mutations L234D and P329R into GpH7-B5, were constructed by the method described in Reference Example 1. Using these expression vectors and the GpL16-k0 expression vector corresponding to an antibody L chain, antibodies were expressed such that P329R and G237A or L234D are introduced into only either of the H chains according to the method described in Reference Example 1 (Table 1).

TABLE 1

| SAMPLE | H1 | MUTATION SITE | H2 | MUTATION SITE |
|---|---|---|---|---|
| pH7-A5/GpH7-B3/GpL16-k0 (SEQ ID NO: 3, 4, 5) | A5 | — | B3 | — |
| GpH7-A5/GpH7-B12/GpL16-k0 (SEQ ID NO: 3, 12, 5) | A5 | — | B12 | P329R |
| GpH7-A48/GpH7-B3/GpL16-k0 (SEQ ID NO: 16, 4, 5) | A48 | P329R | B3 | — |
| GpH7-A26/GpH7-B3/GpL16-k0 (SEQ ID NO: 6, 4, 5) | A26 | G237A | B3 | — |
| GpH7-A26/GpH7-B12/GpL16-k0 (SEQ ID NO: 6, 12, 5) | A26 | G237A | B12 | P329R |
| GpH7-A45/GpH7-B3/GpL16-k0 (SEQ ID NO: 17, 4, 5) | A45 | G237A P329R | B3 | — |
| GpH7-A5/GpH7-B17/GpL16-k0 (SEQ ID NO: 3, 11, 5) | A5 | — | B17 | L234D |
| GpH7-A5/GpH7-B41/GpL16-k0 (SEQ ID NO: 3, 18, 5) | A5 | — | B41 | L234D P329R |
| GpH7-A48/GpH7-B17/GpL16-k0 (SEQ ID NO: 16, 11, 5) | A48 | P329R | B17 | L234D |

The column "SAMPLE" indicates antibody names; the columns "H1" and "H2" indicate names of H chain constant regions of respective antibodies; and the column "MUTATION SITE" indicates mutations that are different compared to GpH7-A5/GpH7-B3/GpL16-k0 ("-": when there is no particular mutation). The SEQ ID NOs are also shown for the amino acid sequences of the H chain and L chain of each antibody.

The combination of G237A and P329R was assessed by using GpH7-A5/GpH7-B3/GpL16-k0 as a polypeptide for introduction of alterations; GpH7-A5/GpH7-B12/GpL16-k0 and GpH7-A48/GpH7-B3/GpL16-k0 as variants in which one of the H chains has been introduced with P329R; GpH7-A45/GpH7-B3/GpL16-k0 as a variant in which G237A has been introduced into the same chain as P329R; and GpH7-A26/GpH7-B12/GpL16-k0 as a variant in which G237A has been introduced into the other chain than P329R. They were compared for the binding activity to each FcγR according to the method described in Reference Example 2 (FIG. 14).

When GpH7-A5/GpH7-B12/GpL16-k0 in which one of the H chains has been introduced with P329R was compared to GpH7-A48/GpH7-B3/GpL16-k0, no significant difference was observed in the pattern of FcγR-binding. Thus, it was thought that P329R has no influence on the FcγR binding even when introduced into an H chain introduced with D356K and H435R or when introduced into an H chain introduced with K439E.

On the other hand, GpH7-A26/GpH7-B3/GpL16-k0, which is a heterodimerized antibody in which only one of the H chains has been introduced with G237A, showed enhanced binding to FcγRIIa R and IIb as compared to GpH7-A5/GpH7-B3/GpL16-k0. However, as compared to GpH7-A5/GpH7-B12/GpL16-k0 in which only one of the H chains has been introduced with P329R, GpH7-A26/GpH7-B12/GpL16-k0 in which the other H chain has been introduced with G237A exhibited a reduced FcγR binding, and thus the effect of G237A to enhance the binding to FcγRIIa R and IIb was not observed. Meanwhile, as compared to GpH7-A48/GpH7-B3/GpL16-k0 in which only one of the H chains has been introduced with P329R, GpH7-A45/GpH7-B3/GpL16-k0 in which G237A has been introduced with the same H chain as P329R showed an enhanced binding to FcγRIIa R and IIb, and thus the effect of G237A to enhance the binding to FcγRIIa R and IIb was observed. Since the binding between the antibody and FcγR was strongly inhibited when G237A was introduced into the chain other than that introduced with P329R, the above results show that, when G237A introduced into GpH7-A5 is combined with P329R introduced into GpH7-B3, they recognize the binding between the antibody and FcγR in the same direction.

The alteration L234D was also assessed in the same manner (FIG. 15). GpH7-A5/GpH7-B17/GpL16-k0, which is a heterodimerized antibody in which only one of the H chains has been introduced with L234D, showed an enhanced binding to FcγRIIa R and IIb as compared to GpH7-A5/GpH7-B3/GpL16-k0. However, as compared to GpH7-A48/GpH7-B3/GpL16-k0 in which only one of the H chains has been introduced with P329R, GpH7-A48/GpH7-B17/GpL16-k0 in which L234D has been introduced into the other H chain exhibited a reduced binding to FcγR other than FcγRIa; and thus the effect of L234D to enhance the binding to FcγRIIa R and IIb was not observed. Meanwhile, as compared to GpH7-A5/GpH7-B12/GpL16-k0 in which only one of the H chains has been introduced with P329R, GpH7-A5/GpH7-B41/GpL16-k0 in which L234D has been introduced into the same H chain as P329R showed an enhanced binding to FcγRIIa R and IIb; and thus the effect of L234D to enhance the binding to FcγRIIa R and IIb was observed. Since the binding between the antibody and FcγR was strongly inhibited when L234D was introduced into the chain other than that introduced with P329R, the above results show that, when L234D introduced into GpH7-B3 is combined with P329R introduced into GpH7-A5, they recognize the binding between the antibody and FcγR in the same direction.

That is, both G237A and L234D increase (/reduce) the FcγR-binding activity of an antibody in the same direction as P329R.

In this way, the hetero-alteration enhanced the binding to FcγR exclusively in either of the X-direction and Y-direction. This finding demonstrates that the interaction with FcγR is enhanced in an asymmetric manner in the heterodimerized antibodies.

[Example 4] Comparison of the FcγR Binding of the Heterodimerized Antibody with that of the Homodimerized Antibody As described in Example 2, the present inventors revealed that the FcγR binding of an antibody via its Fc domain can be enhanced by introducing different alterations to the two H chains of an antibody rather than introducing the same alteration to both H chains. Thus, to discover alterations with such a property, the present inventors carried out the experiment described below.

To construct GpH7-B3 variants, amino acids thought to be involved in the FcγR binding and amino acids around them in GpH7-B3 (SEQ ID NO: 4) constructed as described in Example 2, specifically, Leu at position 234 (EU numbering), Leu at position 235 (EU numbering), Gly at position 236 (EU numbering), Gly at position 237 (EU numbering), Pro at position 238 (EU numbering), Ser at position 329 (EU numbering), Asp at position 265 (EU numbering), Val at position 266 (EU numbering), Ser at position 267 (EU numbering), His at position 268 (EU numbering), Glu at position 269 (EU numbering), Asp at position 270 (EU numbering), Pro at position 271 (EU numbering), Gln at position 295 (EU numbering), Tyr at position 296 (EU numbering), Ser at position 298 (EU numbering), Tyr at position 300 (EU numbering), Ser at position 324 (EU numbering), Asn at position 325 (EU numbering), Lys at position 326 (EU numbering), Ala at position 327 (EU numbering), Leu at position 328 (EU numbering), Pro at position 329 (EU numbering), Ala at position 330 (EU numbering), Pro at position 331 (EU numbering), Ile at position 332 (EU numbering), Glu at position 333 (EU numbering), Lys at position 334 (EU numbering), Thr at position 335 (EU numbering), Ile at position 336 (EU numbering), and Ser at position 337 (EU numbering) were each substituted with 18 types of amino acids excluding the original amino acid and cysteine. Each GpH7-B3 variant was named "A_B", where A represents the information on the amino acid type indicated by one-letter code and the EU numbering of the altered residue, and B indicates the information on the amino acid after substitution. For example, when Gly is substituted for Leu at position 234 (EU numbering), the B3_variant is named L234_01 G. For descriptive purposes, in the information on the amino acid after substitution, a numeral specific for the amino acid is added before each one-letter code. Specifically, the symbols used are the following: 01G for Gly; 02A for Ala; 03V for Val, 04F for Phe; 05P for Pro; 06M for Met; 07I for Ile; 08L for Leu; 09D for Asp; 10E for Glu; 11K for Lys; 12R for Arg; 13S for Ser; 14T for Thr; 15Y for Tyr; 16H for His; 18N for Asn; 19Q for Gln; and 20W for Trp.

Homodimerized antibodies in which both of the H chains have been introduced with a mutation were prepared by the following procedure. Antibodies were expressed using a GpH7-B3 variant as the H chain and GpL16-k0 (SEQ ID NO: 5) as the L chain. The antibodies were prepared according to the method described in Reference Example 1.

The homodimerized antibodies in which both of the H chains have been introduced with a mutation thus prepared are referred to as Ho Ab.

Heterodimerized antibodies in which only one of the H chains has been introduced with a mutation were prepared by the following procedure. Antibodies were expressed using a GpH7-B3 variant and GpH7-A5 (SEQ ID NO: 3) as the H chain and GpL16-k0 (SEQ ID NO: 5) as the L chain. The antibodies were prepared according to the method described in Reference Example 1. The heterodimerized antibodies in which only one of the H chains has been introduced with a mutation thus prepared are referred to as He Ab.

As a control homodimerized antibody, GpH7-B3/GpL16-k0 that was prepared using GpH7-B3 (SEQ ID NO: 4) as the H chain and GpL16-k0 (SEQ ID NO: 5) as the L chain was prepared according to the method described in Reference Example 1. This control homodimerized antibody is referred to as HoCon Ab. As assessed in Example 2, the binding activity of HoCon Ab to each FcγR is not significantly altered as compared to the native IgG1.

As a control heterodimerized antibody, GpH7-A5/GpH7-B3/GpL16-k0 that was prepared using GpH7-A5 (SEQ ID NO: 3) and GpH7-B3 (SEQ ID NO: 4) as the H chain and GpL16-k0 (SEQ ID NO: 5) as the L chain was prepared according to the method described in Reference Example 1. This control heterodimerized antibody is referred to as HeCon Ab. As assessed in Example 2, the binding activity of HeCon Ab to each FcγR was not significantly altered as compared to the native IgG1.

Prepared Ho Ab, He Ab, HeCon Ab, and HoCon Ab were assayed for the binding activity to FcγRIa, FcγRIIa(R), FcγRIIa(H), FcγRIIb, and FcγRIIIa according to the method described in Reference Example 2. As to the assay result for each FcγR, a graph was drawn by the following procedure. The binding activity of He Ab to each FcγR was divided by that of HeCon Ab, and then multiplied by 100; this is referred to as He/Con. The binding activity of Ho Ab to each FcγR is divided by that of HoCon Ab, and then multiplied by 100; this is referred to as Ho/Con. Regarding homodimerized and heterodimerized antibodies prepared using a GpH7-B3 variant comprising an alteration of interest, Ho/Con and He/Con values were plotted on the horizontal and vertical axes, respectively. The results for respective FcγRs, i.e., FcγRIa, FcγRIIa(R), FcγRIIa(H), FcγRIIb, and FcγRIIIa, are summarized in FIGS. 16 to 20. Based on the He/Con and Ho/Con values, each alteration can be interpreted as follows.

1. When the He/Con and Ho/Con values are 100: it means that the FcγR-binding activity of the heterodimerized antibody He Ab and homodimerized antibody Ho Ab, which comprise a GpH7-B3 variant introduced with a mutation of interest, are equivalent to the FcγR-binding activity of the control heterodimerized antibody and control homodimerized antibody, respectively.
2. When the He/Con and Ho/Con values are 100 or less: it means that the FcγR-binding activity of the heterodimerized antibody He Ab and homodimerized antibody Ho Ab, which comprise a GpH7-B3 variant introduced with a mutation of interest, are weaker than the FcγR-binding activity of the control heterodimerized antibody and control homodimerized antibody, respectively.
3. When the He/Con and Ho/Con values are 100 or more: it means that the FcγR-binding activity of the heterodimerized antibody He Ab and homodimerized antibody Ho Ab, which comprise a GpH7-B3 variant introduced with a mutation of interest, are stronger than the FcγR-binding activity of the control heterodimerized antibody and control homodimerized antibody, respectively.
4. When the He/Con value is greater than the Ho/Con value: it means that the FcγR-binding activity of the heterodimerized antibody He Ab comprising a GpH7-B3 variant introduced with a mutation of interest is stronger than the activity of the homodimerized antibody Ho Ab.
5. When the He/Con value is smaller than the Ho/Con value: it means that the FcγR-binding activity of the heterodimerized antibody He Ab comprising a GpH7-B3 variant introduced with a mutation of interest is weaker than the activity of the homodimerized antibody Ho Ab.

Based on the interpretation of items 1 to 5 above, the data points in FIGS. 16 to 20 can be classified as shown in FIG. 21.

When an alteration is present in Region i in FIG. 21, it means that the alteration, when introduced into both H chains of a homodimerized antibody, reduces its binding to FcγR, whereas the same alteration, when introduced into only one H chain of a heterodimerized antibody, has the effect of enhancing its binding to FcγR. That is, the alteration enhances the FcγR binding of the heterodimerized antibody only. As to each FcγR, alterations comprised in Region i are summarized in Table 2 (Tables 2-1 to 2-3), Table 3 (Tables 3-1 and 3-2), Table 4, Table 5, and Table 6.

When an alteration is present in Region ii in FIG. 21, it means that the alteration corresponding the point enhancing the FcγR binding, when introduced into both of H chains of a homodimerized antibody, or when introduced into only one H chain of a heterodimerized antibody, and the effect to enhance the binding is stronger in the heterodimerized antibody. Specifically, alterations in this region have a greater effect of enhancing the FcγR binding in the heterodimerized antibody than in the homodimerized antibody. As to each FcγR, alterations comprised in Region ii are summarized in Table 2 (Tables 2-1 to 2-3), Table 3 (Tables 3-1 and 3-2), Table 4, Table 5, and Table 6.

In each table, He/Con related to the binding activity to FcγRIa, FcγRIIa H, FcγRIIa R, FcγRIIb, and FcγRIIIa is referred to as He/Con_1a, He/Con_2 aH, He/Con_2 aR, He/Con_2 b, and He/Con_3a, respectively; Ho/Con related to the binding activity to FcγRIa, FcγRIIa H, FcγRIIa R, FcγRIIb, and FcγRIIIa is referred to as Ho/Con_1a, Ho/Con_2 aH, Ho/Con_2 aR, Ho/Con_2 b, and Ho/Con_3a, respectively.

When an alteration is present in Region iii in FIG. 21, it means that the alteration corresponding to the point, when introduced into both H chains of a homodimerized antibody, or when introduced into only one H chain of a heterodimerized antibody, enhances the FcγR binding, and the binding enhancement effect is stronger in the homodimerized antibody. Specifically, alterations in this region have a greater effect of enhancing the FcγR binding in the homodimerized antibody than in the heterodimerized antibody.

In the tables below, amino acid alterations are indicated in a way such as A327_03 V. The first alphabetical letter (for example, "A" of A327_03 V) is a one-letter code representing the amino acid residue before alteration, and the following numeral (for example, "327" of A327_03 V) indicates the position of alteration (EU numbering). The last numeral and an alphabetical letter (for example, "03V" of A327_03 V) indicate an alphabetical letter where the amino acid residue after alteration is shown by a one-letter code (numeral representing the amino acid type+ alphabetical letter). Such are indicated as follows: 01G(Gly), 02A(Ala), 03V (Val), 04F(Phe), 05P(Pro), 06M(Met), 07I(Ile), 08L(Leu), 09D(Asp), 10E(Glu), 11K(Lys), 12R(Arg), 13S(Ser), 14T (Thr), 15Y(Tyr), 16H(His), 17C(Cys), 18N(Asn), 19Q(Gln), and 20W(Trp). Thus, for example, "A327_03 V" means "a substitution of V for A at amino acid position 327 (EU numbering)".

TABLE 2-1

| Ia | | |
|---|---|---|
| NAME | Ho/Con_1a | He/Con_1a |
| REGION i | | |
| A327_03V | 94.4 | 103.2 |
| A327_06M | 93.1 | 103.2 |
| A327_07I | 95.5 | 103.5 |
| A327_10E | 98.8 | 103.4 |
| A327_13S | 86.1 | 102.4 |
| A330_05P | 84.4 | 101.4 |
| A330_11K | 94.1 | 103.4 |
| E269_01G | 97.4 | 104.4 |
| E269_02A | 96.2 | 104.4 |
| E269_03V | 95.4 | 102.6 |
| E269_05P | 95.7 | 102.3 |
| E269_07I | 97.1 | 102.8 |
| E269_13S | 95.9 | 103.1 |
| E269_14T | 96.2 | 105.9 |
| E269_16H | 98.4 | 105.8 |
| E269_18N | 92.7 | 101.5 |
| E269_19Q | 99.6 | 105.0 |
| E269_20W | 98.9 | 105.2 |
| E333_02A | 96.2 | 103.2 |
| E333_03V | 98.4 | 105.0 |
| E333_04F | 98.4 | 102.4 |
| E333_05P | 99.2 | 102.3 |
| E333_06M | 99.5 | 102.1 |
| E333_07I | 99.9 | 102.0 |
| E333_08L | 99.0 | 102.3 |
| E333_11K | 95.8 | 102.1 |
| E333_12R | 94.2 | 102.2 |
| E333_14T | 98.7 | 102.1 |
| E333_15Y | 100.0 | 101.2 |
| E333_16H | 99.1 | 100.8 |
| G236_02A | 92.4 | 100.2 |
| I332_12R | 93.2 | 100.1 |
| L234_03V | 98.2 | 104.4 |
| L234_04F | 93.5 | 101.1 |
| L234_06M | 96.5 | 103.8 |
| L234_07I | 99.5 | 103.0 |
| L234_10E | 79.6 | 100.5 |
| L234_15Y | 98.9 | 100.1 |
| L328_03V | 99.2 | 101.0 |
| L328_14T | 98.6 | 100.4 |
| L328_19Q | 99.3 | 101.1 |
| L328_20W | 99.9 | 102.8 |
| P238_03V | 97.9 | 100.4 |
| P238_04F | 98.7 | 101.0 |
| P238_06M | 100.0 | 102.3 |
| P238_08L | 100.0 | 100.9 |
| P238_10E | 91.8 | 101.5 |
| P238_15Y | 99.0 | 100.9 |
| P271_14T | 99.5 | 102.3 |
| P271_15Y | 99.4 | 103.0 |
| P271_16H | 99.4 | 102.1 |
| P329_01G | 89.5 | 100.9 |
| P329_02A | 98.2 | 102.3 |
| Q295_09D | 96.8 | 100.1 |
| Q295_11K | 99.9 | 101.3 |
| Q295_15Y | 97.0 | 101.7 |
| Q295_16H | 99.1 | 102.5 |
| REGION ii | | |
| A327_09D | 101.6 | 102.8 |
| A330_08L | 106.1 | 106.9 |
| A330_09D | 108.0 | 108.6 |
| A330_14T | 104.8 | 105.1 |
| A330_16H | 103.6 | 105.8 |
| E269_04F | 102.4 | 103.1 |
| E269_06M | 101.3 | 103.6 |
| E269_08L | 101.1 | 103.6 |

TABLE 2-1-continued

| Ia | | |
|---|---|---|
| NAME | Ho/Con_1a | He/Con_1a |
| E269_09D | 106.3 | 106.6 |
| E269_15Y | 100.2 | 106.4 |
| E333_01G | 100.4 | 102.7 |
| E333_09D | 103.2 | 103.5 |
| E333_13S | 100.6 | 103.1 |
| G236_20W | 104.4 | 105.2 |
| H268_02A | 105.7 | 108.7 |
| H268_05P | 107.6 | 109.0 |
| H268_07I | 106.4 | 107.8 |
| H268_08L | 105.1 | 107.4 |
| H268_12R | 105.3 | 106.1 |
| H268_14T | 109.0 | 112.2 |
| H268_20W | 106.2 | 106.9 |
| I336_01G | 104.3 | 108.7 |
| I336_02A | 103.1 | 106.0 |
| I336_03V | 104.8 | 105.2 |
| I336_04F | 103.9 | 105.5 |
| I336_06M | 104.0 | 108.2 |
| I336_10E | 107.2 | 107.8 |
| I336_18N | 103.6 | 107.8 |
| K326_12R | 100.1 | 100.1 |
| K326_14T | 102.9 | 104.1 |
| K326_15Y | 101.2 | 105.9 |
| K326_16H | 100.9 | 103.4 |
| K326_18N | 101.9 | 105.1 |
| K334_06M | 104.4 | 104.6 |
| K334_10E | 106.9 | 109.8 |
| K334_12R | 101.7 | 103.7 |
| K334_20W | 104.4 | 105.6 |
| L328_10E | 100.6 | 101.3 |
| P271_02A | 102.5 | 103.5 |
| P271_03V | 102.0 | 102.3 |
| P271_04F | 100.3 | 101.8 |
| P271_06M | 102.0 | 102.5 |
| P271_07I | 101.9 | 102.5 |
| P271_11K | 101.1 | 102.8 |
| P271_12R | 101.2 | 102.4 |
| P271_13S | 100.7 | 102.4 |
| P271_20W | 101.5 | 102.6 |
| Q295_02A | 104.1 | 104.3 |
| Q295_03V | 101.6 | 104.1 |
| Q295_04F | 100.3 | 102.2 |
| Q295_05P | 101.1 | 103.4 |
| Q295_07I | 101.2 | 103.0 |
| Q295_08L | 103.3 | 104.6 |
| Q295_13S | 101.4 | 102.0 |
| Q295_14T | 102.5 | 102.7 |
| Q295_18N | 100.8 | 102.4 |
| S239_01G | 100.7 | 101.3 |

TABLE 2-2

| NAME | Ho/Con_1a | He/Con_1a |
|---|---|---|
| REGION i | | |
| S239_18N | 97.9 | 101.2 |
| S239_19Q | 93.4 | 100.6 |
| S267_08L | 99.9 | 101.4 |
| S267_16H | 98.2 | 100.0 |
| S298_11K | 90.4 | 109.3 |
| S298_12R | 94.5 | 109.4 |
| S298_20W | 71.5 | 104.1 |
| V266_19Q | 91.2 | 100.2 |
| Y300_12R | 96.5 | 104.6 |
| REGION ii | | |
| S239_09D | 100.8 | 101.0 |
| S239_14T | 100.9 | 101.1 |
| S267_01G | 102.2 | 103.2 |
| S267_02A | 108.5 | 108.9 |
| S267_03V | 102.4 | 106.0 |
| S267_09D | 105.8 | 109.7 |

TABLE 2-2-continued

| NAME | Ho/Con_1a | He/Con_1a |
|---|---|---|
| S298_01G | 102.8 | 103.7 |
| S298_02A | 106.5 | 106.6 |
| S298_03V | 106.2 | 109.7 |
| S298_04F | 106.7 | 109.0 |
| S298_06M | 106.3 | 114.5 |
| S298_07I | 103.3 | 107.0 |
| S298_08L | 104.2 | 106.7 |
| S298_10E | 106.1 | 108.2 |
| S298_14T | 106.5 | 107.1 |
| S298_15Y | 103.1 | 107.2 |
| S298_16H | 106.8 | 108.8 |
| S298_18N | 103.9 | 108.1 |
| S298_19Q | 104.7 | 109.4 |
| S324_02A | 102.6 | 102.7 |
| S324_03V | 103.0 | 103.6 |
| S324_08L | 102.7 | 103.2 |
| S324_11K | 100.1 | 102.1 |
| S324_12R | 100.7 | 101.7 |
| S324_14T | 112.4 | 120.9 |
| S324_15Y | 111.7 | 113.8 |
| S324_16H | 110.6 | 112.6 |
| S324_18N | 110.8 | 115.5 |
| S324_19Q | 110.7 | 112.2 |
| S324_20W | 111.5 | 114.3 |
| S337_01G | 102.3 | 106.6 |
| S337_02A | 103.1 | 105.8 |
| S337_03V | 105.1 | 106.7 |
| S337_04F | 104.7 | 106.2 |
| S337_06M | 102.1 | 106.9 |
| S337_07I | 105.3 | 105.3 |
| S337_08L | 105.3 | 105.3 |
| S337_09D | 105.5 | 105.7 |
| S337_10E | 104.2 | 106.4 |
| S337_12R | 105.4 | 105.8 |
| S337_15Y | 103.6 | 103.8 |
| S337_19Q | 104.6 | 104.6 |
| S337_20W | 104.3 | 104.9 |
| T335_04F | 104.8 | 105.0 |
| T335_05P | 106.2 | 106.4 |
| T335_06M | 106.0 | 106.7 |
| T335_07I | 105.1 | 109.1 |
| T335_08L | 105.4 | 114.6 |
| T335_09D | 106.8 | 107.5 |
| T335_10E | 107.8 | 108.8 |
| T335_11K | 102.8 | 110.8 |
| T335_12R | 106.0 | 112.8 |
| T335_15Y | 106.3 | 107.2 |

TABLE 2-3

REGION ii

| NAME | Ho/Con_1a | He/Con_1a |
|---|---|---|
| T335_16H | 104.5 | 105.7 |
| T335_18N | 102.2 | 105.8 |
| T335_19Q | 104.6 | 105.0 |
| T335_20W | 104.2 | 106.2 |
| Y296_06M | 103.8 | 104.0 |
| Y296_10E | 105.7 | 105.8 |
| Y296_11K | 102.0 | 104.7 |
| Y296_12R | 102.9 | 106.3 |
| Y296_13S | 104.6 | 105.1 |
| Y296_14T | 104.8 | 105.1 |
| Y296_16H | 105.3 | 105.8 |
| Y296_18N | 105.0 | 105.6 |
| Y296_19Q | 104.3 | 111.6 |
| Y296_20W | 106.2 | 110.8 |
| Y300_01G | 109.0 | 116.1 |
| Y300_02A | 109.8 | 112.2 |
| Y300_03V | 112.4 | 117.0 |
| Y300_06M | 111.0 | 112.2 |
| Y300_08L | 109.3 | 113.1 |
| Y300_09D | 111.0 | 112.5 |
| Y300_10E | 110.6 | 114.4 |

TABLE 2-3-continued

REGION ii

| NAME | Ho/Con_1a | He/Con_1a |
|---|---|---|
| Y300_11K | 101.2 | 106.9 |
| Y300_13S | 110.3 | 111.1 |
| Y300_14T | 109.6 | 111.7 |
| Y300_19Q | 110.1 | 112.5 |
| Y300_20W | 110.5 | 112.4 |

With respect to FcγRIa, alterations comprised in Regions i and ii (FIG. 21) are shown.

TABLE 3-1

IIa_R

| NAME | Ho/Con_2aR | He/Con_2aR |
|---|---|---|
| REGION i | | |
| A330_05P | 36.2 | 114.8 |
| A330_15Y | 87.5 | 101.9 |
| A330_19Q | 99.1 | 104.1 |
| E333_04F | 92.4 | 102.1 |
| E333_05P | 99.9 | 104.8 |
| E333_07I | 98.3 | 104.4 |
| E333_08L | 97.1 | 103.0 |
| E333_09D | 96.5 | 103.1 |
| E333_15Y | 96.2 | 100.7 |
| G236_14T | 80.0 | 102.7 |
| G237_02A | 84.0 | 126.4 |
| G237_06M | 55.3 | 133.0 |
| G237_08L | 56.6 | 133.4 |
| G237_09D | 73.1 | 155.6 |
| G237_10E | 22.5 | 116.5 |
| G237_13S | 44.4 | 120.7 |
| G237_15Y | 76.0 | 128.6 |
| G237_18N | 73.6 | 150.1 |
| G237_19Q | 14.3 | 120.6 |
| H268_05P | 95.9 | 105.6 |
| H268_11K | 93.4 | 100.4 |
| H268_12R | 98.5 | 104.7 |
| I332_14T | 99.6 | 105.0 |
| I336_06M | 96.4 | 106.5 |
| I336_18N | 94.5 | 104.1 |
| K326_12R | 95.7 | 102.9 |
| K334_20W | 96.4 | 104.8 |
| L234_04F | 43.3 | 104.0 |
| L234_09D | 42.8 | 122.5 |
| L234_10E | 39.9 | 112.2 |
| L234_20W | 53.8 | 107.8 |
| L235_04F | 98.9 | 113.6 |
| L235_09D | 73.0 | 100.7 |
| L328_02A | 97.0 | 116.7 |
| L328_09D | 68.8 | 119.0 |
| L328_10E | 48.1 | 105.4 |
| N325_01G | 26.7 | 106.8 |
| N325_03V | 37.8 | 108.5 |
| N325_04F | 65.7 | 120.3 |
| N325_07I | 77.0 | 133.2 |
| N325_08L | 95.0 | 143.8 |
| N325_09D | 74.8 | 116.0 |
| N325_10E | 49.9 | 104.7 |
| N325_14T | 60.2 | 105.4 |
| N325_15Y | 42.6 | 100.7 |
| N325_20W | 56.0 | 133.8 |
| P238_06M | 88.9 | 139.3 |
| P238_09D | 13.0 | 148.2 |
| P238_10E | 21.4 | 151.3 |
| P238_15Y | 95.9 | 156.2 |
| P238_16H | 25.5 | 121.5 |
| P238_19Q | 19.4 | 103.9 |
| P238_20W | 25.7 | 117.4 |
| P271_09D | 92.4 | 109.7 |
| P271_10E | 88.8 | 102.6 |
| P331_03V | 89.1 | 114.4 |

TABLE 3-1-continued

IIa_R

| NAME | Ho/Con_2aR | He/Con_2aR |
|---|---|---|
| REGION ii | | |
| A327_09D | 120.0 | 123.8 |
| A327_10E | 103.7 | 110.2 |
| A330_01G | 105.9 | 108.9 |
| A330_11K | 105.7 | 110.1 |
| A330_12R | 100.8 | 103.5 |
| E269_09D | 103.2 | 105.3 |
| G237_04F | 112.8 | 126.2 |
| G237_20W | 107.1 | 138.3 |
| H268_01G | 122.0 | 124.2 |
| H268_03V | 104.9 | 108.6 |
| H268_15Y | 106.3 | 109.6 |
| H268_20W | 110.5 | 113.0 |
| I332_06M | 105.4 | 108.8 |
| I336_07I | 105.8 | 108.3 |
| I336_08L | 105.4 | 110.2 |
| K326_03V | 138.9 | 140.7 |
| K326_04F | 132.7 | 135.1 |
| K326_07I | 133.2 | 147.0 |
| K326_08L | 130.7 | 136.8 |
| K326_15Y | 133.8 | 136.4 |
| K326_18N | 113.2 | 115.4 |
| K326_20W | 119.9 | 130.8 |
| K334_02A | 100.1 | 104.9 |
| K334_04F | 109.5 | 110.4 |
| K334_05P | 101.5 | 103.1 |
| K334_08L | 105.1 | 106.2 |
| K334_10E | 105.7 | 105.7 |
| K334_12R | 110.2 | 110.6 |
| K334_13S | 105.6 | 109.1 |
| K334_19Q | 108.1 | 109.1 |
| L235_15Y | 110.8 | 129.3 |
| L235_20W | 114.4 | 130.9 |
| L328_13S | 107.9 | 116.6 |
| L328_14T | 118.2 | 118.9 |
| N325_06M | 123.7 | 152.3 |
| N325_13S | 125.8 | 143.4 |
| P238_03V | 115.8 | 120.4 |
| P238_04F | 146.3 | 174.4 |
| P271_08L | 102.5 | 103.8 |
| P331_02A | 102.2 | 106.0 |
| P331_04F | 106.3 | 110.6 |
| P331_15Y | 105.2 | 112.4 |
| P331_16H | 100.2 | 114.0 |
| P331_20W | 101.9 | 109.8 |
| S239_08L | 105.6 | 121.5 |
| S239_10E | 121.7 | 134.9 |
| S239_18N | 103.0 | 110.7 |
| S267_03V | 114.7 | 116.5 |
| S267_06M | 102.3 | 122.5 |
| S267_09D | 167.1 | 173.0 |
| S267_19Q | 110.3 | 135.2 |
| S298_06M | 102.5 | 108.4 |
| S298_08L | 101.4 | 104.9 |
| S324_04F | 100.6 | 104.0 |
| S324_06M | 117.9 | 123.1 |
| S337_02A | 101.5 | 105.0 |

TABLE 3-2

| NAME | Ho/Con_2aR | He/Con_2aR |
|---|---|---|
| REGION i | | |
| P331_06M | 79.8 | 105.9 |
| P331_07I | 67.0 | 109.9 |
| P331_08L | 74.4 | 101.7 |
| P331_09D | 88.8 | 102.2 |
| P331_10E | 94.6 | 113.3 |
| P331_13S | 87.8 | 104.7 |
| P331_14T | 80.8 | 104.3 |
| P331_18N | 76.9 | 104.6 |

TABLE 3-2-continued

| NAME | Ho/Con_2aR | He/Con_2aR |
|---|---|---|
| Q295_06M | 93.9 | 101.7 |
| Q295_10E | 99.2 | 101.6 |
| S239_05P | 51.2 | 105.7 |
| S239_06M | 82.9 | 100.6 |
| S239_07I | 85.3 | 101.9 |
| S239_14T | 92.3 | 103.4 |
| S337_04F | 98.3 | 104.6 |
| S337_08L | 99.4 | 107.4 |
| S337_11K | 94.6 | 102.9 |
| T335_01G | 97.7 | 103.8 |
| T335_12R | 94.0 | 100.2 |
| Y296_06M | 84.0 | 101.2 |
| Y296_07I | 83.1 | 101.0 |
| Y296_09D | 94.5 | 105.7 |
| Y296_10E | 90.2 | 102.6 |
| Y296_13S | 88.1 | 101.9 |
| Y296_14T | 90.3 | 103.1 |
| Y296_16H | 89.5 | 104.7 |
| Y296_18N | 93.7 | 104.1 |
| Y296_19Q | 88.9 | 102.3 |
| Y300_18N | 87.6 | 100.4 |
| REGION ii | | |
| S337_03V | 102.0 | 106.1 |
| S337_06M | 100.9 | 105.2 |
| S337_07I | 102.8 | 108.9 |
| S337_09D | 113.5 | 114.8 |
| S337_10E | 110.0 | 111.6 |
| S337_12R | 100.4 | 107.2 |
| S337_15Y | 100.4 | 105.4 |
| S337_16H | 106.6 | 108.6 |
| S337_18N | 103.1 | 106.6 |
| S337_19Q | 101.8 | 105.6 |
| S337_20W | 104.7 | 110.5 |
| T335_02A | 102.3 | 102.4 |
| T335_05P | 103.6 | 103.6 |
| T335_07I | 106.7 | 109.2 |
| T335_10E | 108.7 | 111.3 |
| T335_13S | 101.6 | 109.6 |
| T335_14T | 106.0 | 109.8 |
| T335_15Y | 107.1 | 111.4 |
| T335_16H | 102.5 | 108.2 |
| T335_18N | 100.4 | 106.3 |
| T335_19Q | 102.1 | 106.0 |
| T335_20W | 101.2 | 108.7 |
| V266_06M | 145.6 | 149.9 |
| Y296_04F | 106.4 | 109.4 |
| Y296_20W | 106.9 | 109.8 |

With respect to FcγRIIa R, alterations comprised in Regions i and ii (FIG. 21) are shown.

TABLE 4

IIa_H

| NAME | Ho/Con_2aH | He/Con_2aH |
|---|---|---|
| REGION i | | |
| A327_09D | 90.1 | 104.7 |
| A330_19Q | 99.2 | 102.2 |
| E333_04F | 93.6 | 101.6 |
| E333_08L | 96.5 | 101.5 |
| E333_13S | 94.6 | 100.6 |
| E333_14T | 90.4 | 100.4 |
| G236_04F | 63.2 | 117.8 |
| G236_14T | 94.2 | 103.2 |
| G236_15Y | 80.4 | 136.1 |
| I336_03V | 90.4 | 102.2 |
| I336_10E | 93.4 | 101.5 |
| I336_18N | 94.3 | 103.0 |
| K326_01G | 98.2 | 100.5 |
| K326_07I | 78.1 | 100.2 |
| K326_12R | 98.8 | 100.6 |
| K334_13S | 94.9 | 101.6 |

TABLE 4-continued

IIa_H

| NAME | Ho/Con_2aH | He/Con_2aH |
|---|---|---|
| K334_19Q | 97.2 | 101.3 |
| L234_04F | 54.2 | 119.8 |
| L234_15Y | 43.8 | 120.2 |
| L234_20W | 55.3 | 113.5 |
| S239_08L | 87.0 | 104.8 |
| S239_10E | 91.4 | 112.0 |
| S267_09D | 91.5 | 105.4 |
| S267_10E | 98.5 | 102.3 |
| S337_07I | 94.0 | 100.8 |
| S337_08L | 93.1 | 100.3 |
| S337_20W | 96.6 | 101.9 |
| T335_18N | 98.0 | 103.2 |
| T335_20W | 98.7 | 104.8 |
| V266_08L | 91.5 | 104.5 |
| Y296_04F | 95.0 | 100.1 |
| Y296_09D | 99.9 | 104.1 |
| Y296_16H | 85.7 | 103.7 |
| REGION ii | | |
| A330_16H | 100.6 | 101.4 |
| E333_09D | 102.7 | 103.4 |
| G236_03V | 110.7 | 119.4 |
| G236_07I | 101.0 | 115.2 |
| H268_02A | 110.9 | 113.8 |
| H268_18N | 110.1 | 112.1 |
| H268_19Q | 102.3 | 102.4 |
| I336_06M | 100.3 | 106.1 |
| I336_07I | 103.6 | 104.8 |
| I336_08L | 100.9 | 105.5 |
| K326_06M | 101.1 | 103.3 |
| K326_10E | 101.0 | 101.8 |
| K326_19Q | 100.5 | 101.4 |
| K334_04F | 103.3 | 105.7 |
| K334_08L | 103.4 | 104.2 |
| K334_16H | 101.4 | 103.9 |
| L235_04F | 100.7 | 110.6 |
| L235_15Y | 107.1 | 121.5 |
| L235_20W | 111.8 | 117.7 |
| L328_06M | 100.2 | 103.5 |
| L328_14T | 110.3 | 116.2 |
| L328_20W | 111.8 | 112.6 |
| S239_09D | 112.4 | 114.4 |
| S267_02A | 119.5 | 119.8 |
| S324_02A | 101.5 | 102.5 |
| S337_09D | 106.9 | 107.1 |
| S337_10E | 101.3 | 102.4 |
| T335_01G | 100.9 | 103.1 |
| T335_07I | 105.4 | 107.7 |
| T335_10E | 105.2 | 107.6 |
| T335_13S | 101.4 | 106.1 |
| T335_14T | 104.3 | 107.9 |
| T335_15Y | 101.5 | 106.3 |
| T335_16H | 100.4 | 105.3 |
| T335_19Q | 102.8 | 103.1 |
| V266_07I | 104.3 | 105.5 |
| Y296_18N | 100.1 | 103.8 |

With respect to FcγRIIa H, alterations comprised in Regions i and ii (FIG. 21) are shown.

TABLE 5

IIb

| NAME | Ho/Con_2b | He/Con_2b |
|---|---|---|
| REGION i | | |
| A327_07I | 37.6 | 126.7 |
| A330_05P | 35.3 | 136.7 |
| G237_02A | 47.8 | 123.6 |
| G237_06M | 35.3 | 129.9 |
| G237_08L | 49.4 | 148.0 |
| G237_09D | 92.9 | 222.7 |

TABLE 5-continued

IIb

| NAME | Ho/Con_2b | He/Con_2b |
|---|---|---|
| G237_10E | 17.8 | 114.1 |
| G237_13S | 25.7 | 110.8 |
| G237_15Y | 83.1 | 152.5 |
| G237_18N | 63.9 | 180.2 |
| G237_19Q | 5.3 | 107.9 |
| I332_02A | 81.8 | 103.3 |
| I336_06M | 90.1 | 101.4 |
| L234_09D | 68.5 | 150.4 |
| L234_10E | 54.9 | 117.6 |
| L234_20W | 80.6 | 114.4 |
| L235_09D | 78.7 | 106.2 |
| N325_01G | 20.2 | 100.7 |
| N325_03V | 31.8 | 111.1 |
| N325_04F | 65.7 | 143.2 |
| N325_07I | 88.2 | 171.4 |
| N325_09D | 77.0 | 124.3 |
| N325_20W | 44.0 | 168.8 |
| P238_03V | 96.6 | 120.1 |
| P238_06M | 97.1 | 174.0 |
| P238_10E | 97.9 | 232.0 |
| P238_16H | 18.8 | 115.2 |
| P238_19Q | 42.7 | 110.1 |
| P238_20W | 12.6 | 122.7 |
| P271_10E | 95.0 | 109.3 |
| P331_03V | 86.6 | 118.7 |
| P331_06M | 71.5 | 101.7 |
| P331_07I | 63.3 | 114.5 |
| P331_10E | 92.3 | 115.5 |
| S239_05P | 61.0 | 101.5 |
| S239_06M | 84.3 | 100.9 |
| S267_01G | 97.0 | 104.6 |
| S337_07I | 96.6 | 104.0 |
| S337_08L | 90.7 | 100.2 |
| S337_15Y | 93.4 | 100.2 |
| S337_18N | 98.0 | 103.3 |
| S337_20W | 99.6 | 108.8 |
| T335_13S | 95.2 | 101.7 |
| T335_16H | 97.2 | 102.4 |
| T335_18N | 96.1 | 101.6 |
| T335_19Q | 97.3 | 100.1 |
| T335_20W | 94.4 | 103.9 |
| REGION ii | | |
| A327_18N | 100.9 | 113.1 |
| A330_01G | 102.1 | 103.5 |
| G237_04F | 139.8 | 149.2 |
| G237_20W | 165.7 | 193.4 |
| H268_03V | 109.1 | 113.9 |
| H268_05P | 109.0 | 116.1 |
| H268_15Y | 103.8 | 106.3 |
| I332_14T | 105.8 | 106.4 |
| I336_07I | 100.6 | 103.4 |
| I336_08L | 103.0 | 107.4 |
| K326_07I | 169.6 | 198.8 |
| K326_08L | 168.5 | 176.6 |
| K326_20W | 131.8 | 148.5 |
| L235_04F | 110.8 | 118.5 |
| L235_15Y | 126.9 | 149.1 |
| L235_20W | 116.3 | 147.3 |
| L328_02A | 116.7 | 144.5 |
| L328_09D | 158.7 | 198.8 |
| L328_10E | 146.3 | 172.2 |
| L328_13S | 146.6 | 149.2 |
| N325_06M | 159.3 | 217.0 |
| N325_08L | 105.8 | 196.7 |
| N325_13S | 159.3 | 177.2 |
| P238_04F | 209.1 | 312.0 |
| P238_09D | 206.6 | 220.9 |
| P238_15Y | 114.2 | 217.8 |
| P271_09D | 100.1 | 120.1 |
| P331_15Y | 110.7 | 114.4 |
| P331_16H | 100.4 | 116.0 |
| P331_20W | 110.9 | 111.2 |
| S239_03V | 108.0 | 108.4 |
| S239_10E | 175.1 | 180.6 |
| S267_06M | 186.7 | 209.5 |

TABLE 5-continued

| | IIb | |
|---|---|---|
| NAME | Ho/Con__2b | He/Con__2b |
| S267__19Q | 184.9 | 217.5 |
| S298__06M | 101.4 | 101.8 |
| S324__06M | 103.6 | 112.1 |
| S337__16H | 102.7 | 104.6 |
| T335__07I | 104.3 | 106.1 |
| T335__10E | 107.7 | 108.4 |
| T335__14T | 101.9 | 106.6 |
| T335__15Y | 103.9 | 108.2 |
| V266__06M | 231.3 | 251.2 |
| Y296__20W | 102.6 | 103.3 |

With respect to FcγRIIb, alterations comprised in Regions i and ii (FIG. 21) are shown.

TABLE 6

| | IIIa | |
|---|---|---|
| NAME | Ho/Con__3a | He/Con__3a |
| REGION i | | |
| A330__05P | 56.6 | 155.1 |
| A330__07I | 93.0 | 103.1 |
| E333__02A | 93.3 | 105.4 |
| E333__03V | 86.5 | 103.0 |
| E333__04F | 87.1 | 101.1 |
| E333__13S | 95.1 | 102.7 |
| E333__20W | 90.9 | 100.9 |
| G236__15Y | 41.6 | 120.8 |
| G236__20W | 58.3 | 135.4 |
| H268__18N | 90.3 | 104.1 |
| I332__06M | 95.4 | 101.2 |
| I336__08L | 95.8 | 106.3 |
| L234__04F | 49.9 | 118.1 |
| L234__07I | 98.2 | 103.1 |
| L234__09D | 52.8 | 116.8 |
| L234__10E | 64.7 | 114.5 |
| L234__15Y | 64.7 | 130.2 |
| L234__20W | 37.1 | 106.8 |
| P238__09D | −0.1 | 105.8 |
| P238__10E | 0.8 | 104.7 |
| P271__01G | 88.0 | 113.2 |
| S324__02A | 99.8 | 104.1 |
| S337__04F | 95.6 | 101.4 |
| S337__14T | 97.2 | 101.0 |
| S337__15Y | 99.0 | 101.9 |
| S337__20W | 87.8 | 100.8 |
| T335__13S | 97.6 | 105.1 |
| T335__15Y | 91.5 | 104.3 |
| T335__16H | 99.5 | 103.9 |
| T335__19Q | 97.7 | 102.2 |
| T335__20W | 91.8 | 101.8 |
| V266__08L | 90.5 | 118.0 |
| REGION ii | | |
| E333__09D | 109.1 | 112.1 |
| H268__02A | 118.0 | 122.2 |
| I332__01G | 103.6 | 110.7 |
| I336__02A | 103.6 | 111.0 |
| I336__03V | 110.0 | 112.2 |
| I336__06M | 107.0 | 108.9 |
| I336__07I | 100.2 | 103.1 |
| I336__18N | 100.6 | 104.0 |
| K326__07I | 133.5 | 138.6 |
| K326__08L | 113.9 | 114.2 |
| K334__01G | 103.6 | 121.4 |
| K334__09D | 149.7 | 159.7 |
| Q295__14T | 108.2 | 114.7 |
| S267__02A | 145.3 | 150.4 |
| S267__09D | 159.7 | 180.8 |
| S298__14T | 106.7 | 112.6 |
| S324__15Y | 100.1 | 101.4 |
| S324__16H | 103.1 | 103.7 |

TABLE 6-continued

| | IIIa | |
|---|---|---|
| NAME | Ho/Con__3a | He/Con__3a |
| S337__09D | 105.5 | 109.9 |
| S337__10E | 100.2 | 105.0 |
| S337__18N | 101.5 | 104.1 |
| T335__07I | 107.0 | 107.2 |
| T335__10E | 102.4 | 106.9 |
| T335__14T | 102.5 | 108.5 |

With respect to FcγRIIIa, alterations comprised in Regions i and ii (FIG. 21) are shown.

The alterations revealed in this Example, together with Example 2, are thought to support the concept of the improvement of FcγR recognition ability by the heterodimerized antibody described in Example 1. Alterations in Region i in FIG. 21 are thought to reduce the FcγR-binding activity when introduced into both H chains in a conventional way, and have not been recognized as alterations that enhance the binding. The present inventors, however, succeeded in demonstrating that such alterations also improve the FcγR-binding activity by introducing them into only one of the two H chains.

[Example 5] Method for Determining Combinations of Alterations of Heterodimerized Antibodies As described in Example 3, the effect of an alteration on the FcγR binding of a heterodimerized antibody differs in the direction depending on alteration. For this reason, when several alterations are combined to further enhance or reduce the FcγR binding of a heterodimerized antibody, it is necessary to unify the direction of the effect of each alteration on the FcγR binding. If two alterations were introduced in a way that their effects to enhance the FcγR binding of an antibody are different in the direction, the effects of the alterations would annihilate each other and the effect of enhancing the binding would not be observed in spite of the combination of alterations for enhancing the FcγR binding. However, there is no method for predicting in advance which H chain should be introduced with an alteration. Thus, in order to find an appropriate method of combination, generally antibodies in which alterations of interest are introduced into the same chain or different H chains need to be prepared, and they are compared to each other for the FcγR-binding activity. For example, when all of three different types of alterations are introduced into a homodimerized antibody, a single type of antibody in which each alteration has been introduced into both H chains may be prepared. In the case of a heterodimerized antibody, however, it is necessary to determine which H chain should be introduced with each alteration. In this case, as shown in FIG. 22, there are a maximum of four combinations to be tried; i.e., the number of variants that should be prepared for assessment of the alteration combinations is very large, and this is inefficient. Thus, the present inventors tested a method for identifying the direction in which an alteration of interest has an effect on the FcγR binding of an antibody by combining the alteration with P329R that inhibits the FcγR binding of an antibody from only one direction.

The present inventors examined how the FcγRIIIa binding was altered when alterations L234Y, G236W, and S298A that enhance the FcγRIIIa binding were each introduced into the same H chain as P329R or the other H chain of a heterodimerized antibody found in Example 4. First, variants of interest were expressed and prepared according to the method described in Reference Example 1, using GpH7-A5 as an H chain; and GpL16-k0 as the L chain; and as the other H chain, GpH7-HA5 (SEQ ID NO: 19), GpH7-HA6 (SEQ ID NO: 20), and GpH7-HA11 (SEQ ID NO: 21) resulting from the introduction of L234Y, G236W, and S298A, respectively, into GpH7-B12 introduced with the alteration P329R. Furthermore, antibodies of interest were expressed and prepared according to the method described in Reference Example 1, using as an H chain, GpH7-A48 (SEQ ID NO: 16) resulting from the introduction of P329R into GpH7-A5; and GpL16-k0 as the L chain; and as the other H chain, GpH7-B3-01-15Y (SEQ ID NO: 22), GpH7-B3-03-20W (SEQ ID NO: 23), and GpH7-B3-15-02A (SEQ ID NO: 24) resulting from the introduction of L234Y, G236W, and S298A, respectively, into GpH7-B3. The antibodies thus obtained were named GpH7-A5/GpH7-HA5/GpL16-k0 (SEQ ID NOs: 3, 19, and 5, respectively), GpH7-A5/GpH7-HA6/GpL16-k0 (SEQ ID NOs: 3, 20, and 5, respectively), GpH7-A5/GpH7-HA11/GpL16-k0 (SEQ ID NOs: 3, 21, and 5, respectively), GpH7-A48/GpH7-B3-01-15Y/GpL16-k0 (SEQ ID NOs: 16, 22, and 5, respectively), GpH7-A48/GpH7-B3-03-20W/GpL16-k0 (SEQ ID NOs: 16, 23, and 5, respectively), and GpH7-A48/GpH7-B3-15-02A/GpL16-k0 (SEQ ID NO: 16, 24, and 5, respectively). The variants were compared to each other for the FcγRIIIa-binding activity according to the method described in Reference Example 2. The effects of the combination of L234Y, G236W, and S298A with P329R are summarized in Table 7.

was inhibited when the alteration was introduced into the H chain different from that introduced with P329R. In the case of G236W, the binding activity of GpH7-A5/GpH7-HA6/GpL16-k0 corresponding to the former was 56, while the binding activity of GpH7-A48/GpH7-B3-03-20W/GpL16-k0 corresponding to the latter was 13; thus, the FcγR binding was inhibited when the alteration was introduced into the H chain different from that introduced with P329R. In the case of S298A, the binding activity of GpH7-A5/GpH7-HA11/GpL16-k0 corresponding to the former was 84, while the binding activity of GpH7-A48/GpH7-B3-15-02A/GpL16-k0 corresponding to the latter was 47; thus, the FcγR-binding activity was inhibited when the alteration was introduced into the H chain different from that introduced with P329R. For all the alterations, the FcγRIIIa binding was inhibited when an alteration was introduced into the H chain different from that introduced with P329R, as described as the latter case. If the H chain introduced with P329R corresponded to the $H_A$ chain of FIG. 3, P329R is thought to inhibit the binding in the X-direction. Since combinations that resulted in significant inhibition of the binding are those when L234Y, G236W, or S298A were introduced into the H chain different from that introduced with P329R, in this case the alterations would have been introduced into the HB chain. Since the effect to enhance the FcγRIIIa binding was markedly inhibited when any of the alterations L234Y, G236W, and S298A was introduced into the H chain different from that introduced with P329R, all the alterations, when introduced into the $H_B$ chain, enhanced the FcγRIIIa binding from the X-direction, which is inhibited by P329R. Thus, it was thought that the FcγRIIIa binding can be further enhanced by introducing these alterations into the same H chain.

TABLE 7

| SAMPLE | H1 | MUTATION SITE | H2 | MUTATION SITE | | FcγRIIIa BINDING ACTIVITY |
|---|---|---|---|---|---|---|
| GpH7-A5/GpH7-B3/GpL16-k0 (SEQ ID NO: 3, 4, 5) | A5 | — | B3 | — | — | 100 |
| GpH7-A48/GpH7-B3-01-15Y/GpL16-k0 (SEQ ID NO: 16, 22, 5) | A48 | P329R | B3-01-15Y | L234Y | — | 11 |
| GpH7-A5/GpH7-HA5/GpL16-k0 (SEQ ID NO: 3, 19, 5) | A5 | — | HA5 | L234Y | P329R | 60 |
| GpH7-A48/GpH7-133-03-20W/GpL16-k0 (SEQ ID NO: 16, 23, 5) | A48 | P329R | B3-03-20W | G236W | — | 13 |
| GpH7-A5/GpH7-HA6/GpL16-k0 (SEQ ID NO: 3, 20, 5) | A5 | — | HA6 | G236W | P329R | 56 |
| GpH7-A48/GpH7-B3-15-02A/GpL16-k0 (SEQ ID NO: 16, 24, 5) | A48 | P329R | B3-15-02A | S298A | — | 47 |
| GpH7-A5/GpH7-HA11/GpL16-k0 (SEQ ID NO: 3, 21, 5) | A5 | — | HA11 | S298A | P329R | 84 |

The column "SAMPLE" indicates antibody names; the columns "H1" and "H2" indicate names of the H chain constant region of respective antibodies; and the column "MUTATION SITE" indicates mutations that are different in comparison with GpH7-A5/GpH7-B3/GpL16-k0 ("-": when there is no particular mutation). The FcγRIIIa-binding activity is indicated as a relative binding activity when setting the FcγRIIIa binding of GpH7-A5/GpH7-B3/GpL16-k0 (SEQ ID NO: 3, 4, and 5, respectively) as 100. The SEQ ID NOs are also shown for the amino acid sequences of the H chain and L chain of each antibody.

Based on the result, the alterations were compared for the FcγRIIIa-binding activity when each alteration has been introduced into the same H chain as P329R or the H chain different from that introduced with P329R. In the case of L234Y, the binding activity of GpH7-A5/GpH7-HA5/GpL16-k0 corresponding to the former was 60, while the binding activity of GpH7-A48/GpH7-B3-01-15Y/GpL16-k0 corresponding to the latter was 11; thus, the FcγR binding The above-described hypothesis was tested by assessing whether the FcγR binding is enhanced by introducing two of L234Y, G236W, and S298A into the same H chain or different H chains. Expression vectors inserted with GpH7-TA1 (SEQ ID NO: 25), GpH7-TA2 (SEQ ID NO: 26), and GpH7-TA3 (SEQ ID NO: 27), resulting from the introduction of L234Y, G236W, and S298A into GpH7-A5, respectively; and expression vectors inserted with GpH7-B3-01-15Y (SEQ ID NO: 22), GpH7-B3-03-20W (SEQ ID NO: 23), and GpH7-B3-15-02A (SEQ ID NO: 24), resulting from the introduction of L234Y, G236W, and S298A into GpH7-B3, respectively, were constructed according to the method described in Reference Example 1. In addition, expression vectors inserted with the following were constructed: GpH7-TA4 (SEQ ID NO: 28) resulting from the introduction of L234Y and G236W into GpH7-A5; GpH7-TA5 (SEQ ID NO: 29) resulting from the introduction of L234Y and S298A into GpH7-A5; and GpH7-TA6 (SEQ ID NO: 30) resulting from the introduction of G236W and S298A into GpH7-A5. These were combined in a manner as shown in Table 8, and GpL16-k0 was added as the L chain to each combination. Antibodies of interest were expressed and prepared according to the method described in Reference Example 1. Regarding the expressed samples, information on the H chains and mutation sites, and assay results on the FcγRIIIa binding of the antibody are summarized in Table 8.

activity of 131 of GpH7-A5/GpH7-B3-01-15Y/GpL16-k0 introduced with L234Y alone, while it was decreased as compared to the binding activity of 163 of GpH7-A5/GpH7-B3-15-02A/GpL16-k0 introduced with S298A alone. That is, since the binding activity of GpH7-TA1/GpH7-B3-15-02A/GpL16-k0 was not increased as compared to when S298A alone was introduced, it can be said that the effect to further increase the FcγRIIIa-binding activity was not provided when S298A and L234Y were introduced into different H chains. Meanwhile, the FcγRIIIa-binding activity of GpH7-TA5/GpH7-B3/GpL16-k0 in which L234Y and

TABLE 8

| SAMPLE | H1 | MUTATION SITE | H2 | MUTATION SITE | FcγRIIIa BINDING ACTIVITY |
|---|---|---|---|---|---|
| GpH7-A5/GpH7-B3-01-15Y/GpL16-k0 (SEQ ID NO: 3, 22, 5) | A5 | — | B3-01-15Y | L234Y | 131 |
| GpH7-A5/GpH7-B3-03-20W/GpL16-k0 (SEQ ID NO: 3, 23, 5) | A5 | — | B3-03-20W | G236W | 140 |
| GpH7-A5/GpH7-B3-15-02A/GpL16-k0 (SEQ ID NO: 3, 24, 5) | A5 | — | B3-15-02A | S298A | 163 |
| GpH7-TA2/GpH7-B3-01-15Y/GpL16-k0 (SEQ ID NO: 26, 22, 5) | TA2 | G236W | B3-01-15Y | L234Y | 130 |
| GpH7-TA4/GpH7-B3/GpL16-k0 (SEQ ID NO: 28, 4, 5) | TA4 | L234Y G236W | B3 | — | 168 |
| GpH7-TA1/GpH7-B3-15-02A/GpL16-k0 (SEQ ID NO: 25, 24, 5) | TA1 | L234Y | B3-15-02A | S298A | 142 |
| GpH7-TA5/GpH7-B3/GpL16-k0 (SEQ ID NO: 29, 4, 5) | TA5 | L234Y S298A | B3 | — | 208 |
| GpH7-TA3/GpH7-B3-03-20W/GpL16-k0 (SEQ ID NO: 27, 23, 5) | TA3 | S298A | B3-03-20W | G236W | 70 |
| GpH7-TA6/GpH7-B3/GpL16-k0 (SEQ ID NO: 30, 4, 5) | TA6 | G236W S298A | B3 | — | 228 |

The column "SAMPLE" indicates antibody names; the columns "H1" and "H2" indicate names of the H chain constant region of respective antibodies; and the column "MUTATION SITE" indicates mutations that are different in comparison with GpH7-A5/GpH7-B3/GpL16-k0 ("-": when there is no particular mutation). The FcγRIIIa-binding activity is indicated as a relative binding activity when setting the FcγRIIIa binding of GpH7-A5/GpH7-B3/GpL16-k0 as 100. The SEQ ID NOs are also shown for the amino acid sequences of the H chain and L chain of each antibody.

The effect of the combination of L234Y and G236W was assessed based on the result shown in Table 8. The FcγRIIIa-binding activity of GpH7-TA2/GpH7-B3-01-15Y/GpL16-k0 in which L234Y and G236W were introduced into different H chains was 130, and was not increased as compared to the binding activity of 131 of GpH7-A5/GpH7-B3-01-15Y/GpL16-k0 introduced with L234Y alone, while it was decreased as compared to the binding activity of 140 of GpH7-A5/GpH7-B3-03-20W/GpL16-k0 introduced with G236W alone. Meanwhile, the binding activity of GpH7-TA4/GpH7-B3/GpL16-k0 in which L234Y and G236W were introduced into the same H chain was 168, and was increased as compared to the binding activity of GpH7-A5/GpH7-B3-01-15Y/GpL16-k0 introduced with L234Y alone and GpH7-A5/GpH7-B3-03-20W/GpL16-k0 introduced with G236W alone. As predicted, this result demonstrates that L234Y and G236W, when introduced into the same H chain, further increase the FcγRIIIa-binding activity.

Then, the effect of the combination of L234Y and S298A was assessed based on Table 8. The FcγRIIIa-binding activity of GpH7-TA1/GpH7-B3-15-02A/GpL16-k0 in which L234Y and S298A were introduced into different H chains was 142, and was increased as compared to the binding activity of 131 of GpH7-A5/GpH7-B3-01-15Y/GpL16-k0 introduced with L234Y alone, while it was decreased as compared to the binding activity of 163 of GpH7-A5/GpH7-B3-15-02A/GpL16-k0 introduced with S298A alone. That is, since the binding activity of GpH7-TA1/GpH7-B3-15-02A/GpL16-k0 was not increased as compared to when S298A alone was introduced, it can be said that the effect to further increase the FcγRIIIa-binding activity was not provided when S298A and L234Y were introduced into different H chains. Meanwhile, the FcγRIIIa-binding activity of GpH7-TA5/GpH7-B3/GpL16-k0 in which L234Y and S298A were introduced into the same H chain was 208, and was increased as compared to GpH7-A5/GpH7-B3-01-15Y/GpL16-k0 introduced with L234Y alone and GpH7-A5/GpH7-B3-15-02A/GpL16-k0 introduced with S298A alone. As predicted, this result demonstrates that L234Y and S298A, when introduced into the same H chain, further increase the FcγRIIIa-binding activity.

Next, the effect of the combination of G236W and S298A was assessed based on Table 8. The FcγRIIIa-binding activity of GpH7-TA3/GpH7-B3-03-20W/GpL16-k0 in which G236W and S298A were introduced into different H chains was 70, and was decreased as compared to the binding activity of 140 of GpH7-A5/GpH7-B3-03-20W/GpL16-k0 introduced with G236W alone, and the binding activity of 163 of GpH7-A5/GpH7-B3-15-02A/GpL16-k0 introduced with S298A alone. Meanwhile, the binding activity of GpH7-TA6/GpH7-B3/GpL16-k0 in which G236W and S298A were introduced into the same H chain was 228, and was increased as compared to GpH7-A5/GpH7-B3-03-20W/GpL16-k0 introduced with G236W alone and GpH7-A5/GpH7-B3-15-02A/GpL16-k0 introduced with S298A alone. As predicted, this result demonstrates that G236W and S298A, when introduced into the same H chain, further increase the FcγRIIIa-binding activity.

As was initially predicted, these results demonstrate that L234Y, G236W, and S298A, only when each is introduced into the same H chain, enhance the binding. This data supports that L234Y, G236W, and S298A, when being present in the same chain, enhance the FcγR binding from the same direction. That is, this shows that one can determine a method for appropriately combining two alterations based on a result predicted from the result of comparison of the FcγRIIIa-binding activity, combining P329R with each of the alterations. In other words, combining with P329R is a useful method for predicting a method of combining alterations in heterodimerized antibodies. This method can be used to reveal other useful combinations of alterations.

Combinations of two or more alterations were considered based on the result of comparison of the FcγRIIIa-binding activity combining P329R with each of the alterations. It was demonstrated that L234Y and G236W, G236W and S298A, and S298A and L234Y, when introduced into the same H chain, respectively enhance the interaction with FcγRIIIa from the same direction. That is, from this result, it was thought that L234Y, G236W, and S298A all enhance the FcγRIIIa-binding activity from the same direction, and thus these alterations, when introduced into the same H chain, were expected to maximally enhance the FcγRIIIa-binding activity. To assess this hypothesis, GpH7-TA4, GpH7-TA5, and GpH7-TA6 were constructed by introducing into GpH7-A5 each of the alteration groups of L234Y and G236W, L234Y and S298A, and G236W and S298A; GpH7-B3-01-15Y, GpH7-B3-03-20W, and GpH7-B3-15-02A were constructed by introducing L234Y, G236W, and S298A, respectively, into GpH7-B3; expression vectors inserted with the above constructs were prepared according to Reference Example 1. The vectors were combined in a way that the three alterations, L234Y, G236W, and S298A, were introduced into either H chain; and GpL16-k0 was added as the L chain; and antibodies of interest were expressed and prepared according to the method described in Reference Example 1. Furthermore, GpH7-TA7 (SEQ ID NO: 31) resulting from the introduction of three alterations, L234Y, G236W, and S298A into GpH7-A5 was constructed, and combined with GpH7-B3 and GpL16-k0 to express and purify an antibody of interest according to the method described in Reference Example 1. A list of antibodies prepared as described herein and the result of comparison of the FcγRIIIa-binding activity between antibodies are shown in Table 9.

As was predicted from the result of comparison of the FcγRIIIa-binding activity combining P329R with each alteration, GpH7-TA7/GpH7-B3/GpL16-k0 in which L234Y, G236W, and S298A were introduced into the same H chain exhibited most strongly enhanced FcγRIIIa binding. That is, the result demonstrates that one can predict a method for appropriately combining two or more alterations by comparing the FcγRIIIa-binding activity combining P329R with each alteration.

[Example 6] Comparison of Conventional Homodimerized Antibody and Novel Heterodimerized Antibody Based on Heterodimerized Antibody The results shown in Tables 7, 8, and 9 of Example 5 demonstrate that hetero-alterations which each alone enhances the FcγRIIIa-binding activity, when appropriately combined together, can further enhance the FcγRIIIa binding. Specifically, it was demonstrated that the alterations L234Y, G236W, and S298A, when introduced into the same H chain, further increase the FcγR-binding activity.

Then, the present inventors examined whether, even multiple alterations are combined, the resulting heterodimerized antibody still had the characteristic of the heterodimerized antibody that the heterodimerized antibody introduced with multiple alterations exhibits more strongly enhanced FcγR binding than the homodimerized antibody introduced with the corresponding multiple alterations. Specifically, GpH7-TA7 and GpH7-TA45 (SEQ ID NO: 32) resulting from the introduction of L234Y, G236W, and S298A into GpH7-A5 and GpH7-B3, respectively, were prepared according to the

TABLE 9

| SAMPLE | H1 | MUTATION SITE | | | H2 | MUTATION SITE | FcγRIIIa BINDING ACTIVITY |
|---|---|---|---|---|---|---|---|
| GpH7-TA4/GpH7-B3-15-02A/GpL16-k0 (SEQ ID NO: 28, 24, 5) | TA4 | L234Y | G236W | — | B3-15-02A | S298A | 151 |
| GpH7-TA5/GpH7-B3-03-20W/GpL16-k0 (SEQ ID NO: 29, 23, 5) | TA5 | L234Y | S298A | — | B3-03-20W | G236W | 97 |
| GpH7-TA6/GpH7-B3-01-15Y/GpL16-k0 (SEQ ID NO: 30, 22, 5) | TA6 | G236W | S298A | — | B3-01-15Y | L234Y | 103 |
| GpH7-TA7/GpH7-B3/GpL16-k0 (SEQ ID NO: 31, 4, 5) | TA7 | L234Y | G236W | S298A | B3 | — | 201 |

The column "SAMPLE" indicates antibody names; the columns "H1" and "H2" indicate names of the H chain constant region of respective antibodies; and the column "MUTATION SITE" indicates mutations that are different in comparison with GpH7-A5/GpH7-B3/GpL16-k0 ("-": when there is no particular mutation). The FcγRIIIa-binding activity is indicated as a relative binding activity when setting the FcγRIIIa-binding activity of GpH7-A5/GpH7-B3/GpL16-k0 as 100. The SEQ ID NOs are also shown for the amino acid sequences of the H chain and L chain of each antibody.

method described in Reference Example 1. As shown in Table 10, the heterodimerized antibodies GpH7-TA7/GpH7-B3/GpL16-k0 and GpH7-A5/GpH7-TA45/GpL16-k0 in which L234Y, G236W, and S298A were introduced into only one H chain, and the homodimerized antibody GpH7-TA7/GpH7-TA45/GpL16-k0 in which L234Y, G236W, and S298A were introduced into both H chains were expressed and purified according to the method described in Reference Example 1. These antibodies were compared for the FcγRIIIa binding according to the method described in Reference Example 2 (Table 10).

TABLE 10

| SAMPLE | H1 | MUTATION SITE | | | H2 | MUTATION SITE | | | FcγR BINDING ACTIVITY |
|---|---|---|---|---|---|---|---|---|---|
| GpH7-A5/GpH7-B3/GpL16-k0 (SEQ ID NO: 3, 4, 5) | A5 | — | — | — | B3 | — | — | — | 100 |
| GpH7-TA7/GpH7-B3/GpL16-k0 (SEQ ID NO: 31, 4, 5) | TA7 | L234Y | G236W | S298A | B3 | — | — | — | 210 |
| GpH7-A5/GpH7-TA45/GpL16-k0 (SEQ ID NO: 3, 32, 5) | A5 | — | — | — | TA45 | L234Y | G236W | S298A | 225 |
| GpH7-TA7/GpH7-TA45/GpL16-k0 (SEQ ID NO: 31, 32, 5) | TA7 | L234Y | G236W | S298A | TA45 | L235Y | G237W | S299A | 48 |

The column "SAMPLE" indicates antibody names; the columns "H1" and "H2" indicate names of the H chain constant region of respective antibodies; and the column "MUTATION SITE" indicates mutations that are different in comparison with GpH7-A5/GpH7-B3/GpL16-k0 ("-": when there is no mutation). The FcγRIIIa-binding activity is indicated as a relative binding activity when setting the FcγRIIIa binding of GpH7-A5/GpH7-B3/GpL16-k0 as 100. The SEQ ID NOs are also shown for the amino acid sequences of H chain and L chain of each antibody.

The result shown in Table 10 demonstrates that the homodimerized antibody GpH7-TA7/GpH7-TA45/GpL16-k0 in which both of the H chains were introduced with L234Y, G236W, and S298A exhibited reduced FcγRIIIa binding as compared to the heterodimerized antibodies GpH7-TA7/GpH7-B3/GpL16-k0 and GpH7-A5/GpH7-TA45/GpL16-k0 in which only one of the H chains were introduced with L234Y, G236W, and S298A. This shows that the characteristic of the alterations L234Y, G236W, and S298A that they increase the FcγR-binding activity of a heterodimerized antibody but reduces the FcγR-binding activity of a homodimerized antibody, is retained even when multiple alterations are combined together.

Then, the present inventors examined whether a heterodimerized antibody in which only one of the H chains was introduced with L234Y, G236W, and S298A retains the directionality of the FcγRIIIa binding discussed in Example 3.

GpH7-TA8 (SEQ ID NO: 33) and GpH7-B12 (SEQ ID NO: 12) resulting from the introduction of P329R into GpH7-TA7 and GpH7-B3, respectively, were prepared according to the method described in Reference Example 1. As shown in Table 11, the heterodimerized antibody GpH7-TA8/GpH7-B3/GpL16-k0 in which L234Y, G236W, and S298A were introduced into the same H chain as P329R, and the heterodimerized antibody GpH7-TA7/GpH7-B12/GpL16-k0 in which L234Y, G236W, and S298A were introduced into the H chain different from that introduced with P329R were prepared according to the method described in Reference Example 1. As to the FcγRIII-binding activity, these antibodies were compared with the heterodimerized antibody GpH7-TA7/GpH7-B3/GpL16-k0 in which one of the H chains was introduced with L234Y, G236W, and S298A according to the method described in Reference Example 2 (Table 11).

TABLE 11

| SAMPLE | H1 | MUTATION SITE | | | | H2 | MUTATION SITE | FcγRIIIa BINDING ACTIVITY |
|---|---|---|---|---|---|---|---|---|
| GpH7-A5/GpH7-B3/GpL16-k0 (SEQ ID NO: 3, 4, 5) | A5 | — | — | — | — | B3 | — | 100 |
| GpH7-TA7/GpH7-B3/GpL16-k0 (SEQ ID NO: 31, 4, 5) | TA7 | L234Y | G236W | S298A | — | B3 | — | 210 |
| GpH7-TA7/GpH7-B12/GpL16-k0 (SEQ ID NO: 31, 12, 5) | TA7 | L234Y | G236W | S298A | — | B12 | P329R | 11 |
| GpH7-TA8/GpH7-B3/GpL16-k0 (SEQ ID NO: 33, 4, 5) | TA8 | L234Y | G236W | S298A | P329R | B3 | — | 150 |

The column "SAMPLE" indicates antibody names; the columns "H1" and "H2" indicate names of the H chain constant region of respective antibodies; and the column "MUTATION SITE" indicates mutations that are different in comparison with GpH7-A5/GpH7-B3/GpL16-k0 ("-": when there is no particular mutation). The FcγRIIIa-binding activity is indicated as a relative binding activity when setting the FcγRIIIa binding of GpH7-A5/GpH7-B3/GpL16-k0 as 100. The SEQ ID NOs are also shown for the amino acid sequences of H chain and L chain of each antibody.

The result shown in Table 11 demonstrates that the heterodimerized antibody GpH7-TA8/GpH7-B3/GpL16-k0 in which the group of alterations L234Y, G236W, and S298A was introduced into the same H chain as P329R, and the heterodimerized antibody GpH7-TA7/GpH7-B12/GpL16-k0 in which the group of alterations L234Y, G236W, and S298A was introduced into the H chain different from that introduced with P329R both exhibited reduced FcγRIIIa-binding activities as compared to GpH7-TA7/GpH7-B3/GpL16-k0. The FcγRIIIa-binding activity of GpH7-TA7/GpH7-B12/GpL16-k0 was 11, and was markedly reduced as compared to the activity of 150 of GpH7-TA8/GpH7-B3/GpL16-k0. This result shows the characteristic that the FcγR-binding activity is markedly reduced if multiple of the alterations L234Y, G236W, and S298A are introduced into an H chain, when they are introduced into the H chain different from that introduced with P329R, which was observed in Example 3 for the alterations L234Y, G236W, and S298A.

The above findings demonstrate that an appropriate combination of alterations that enhance the FcγR binding can further increase the FcγR-binding activity while keeping the characteristic of a heterodimerized antibody.

[Example 7] Comparison with Prior Art: Comparison Between Heterodimerized Variants and Amino Acid-Altered Antibodies that Enhance FcγRIIIa Binding Alterations that increase the ADCC activity by enhancement of the FcγRIIIa binding are already known. For example, the alterations S239D, I332E, and A330L are known as mutations that enhance the FcγRIIIa binding the most when introduced into both H chains of an antibody (Proc. Natl. Acad. Sci. USA, 103, 4005-4010, 2006). The antitumor activity of an antibody was demonstrated to be increased by the enhancement of the antibody-dependent cellular cytotoxic (ADCC) activity. Enhancing the FcγRIIIa-binding of an antibody is an effective means to enhance the utility of antibodies as pharmaceuticals. However, as shown in the Examples above, there are thought to be limitations on the enhancement of the FcγR-binding activity using homodimerized antibodies. Thus, it was thought that the FcγR-binding activity can be further increased by hetero-alteration.

As mentioned in Example 1, the Fc domain of an antibody interacts with FcγR in an asymmetric manner. In the case of an antibody introduced with the alterations S239D, I332E, and A330L, in view of the three-dimensional structure, it is thought that, in the $H_A$ chain, all of the altered residues of S239D, I332E, and A330L are involved in the enhancement of the interaction with FcγR, while in the $H_B$ chain, residues other than S239D are out of contact with FcγR and do not contribute to the enhancement of the FcγR-binding activity (FIG. 23). That is, in light of the asymmetry of interaction between the Fc domain and FcγR, each alteration introduced by the conventional antibody alteration technology is not sufficiently capable of interaction with FcγR and this is thought to be sufficient for optimizing the antibody/FcγR interaction. For example, in the case of above-described alterations S239D, I332E, and A330L, it is thought that the FcγRIIIa binding can be further enhanced by introducing alterations that enhance the interaction with FcγRIIIa on the $H_B$ chain side, instead of introducing the above alterations into $H_B$ chain. That is, the FcγR binding could be further enhanced by using the technology of the present invention for producing heterodimerized antibodies by introducing different alterations to each antibody H chain (hereinafter referred to as "heterodimerized antibody technology") than using the technology for introducing the same alteration to both antibody H chain (hereinafter referred to as "prior art" or "homodimerized antibody technology").

In view of the three-dimensional structure of the Fc/FcγRIIIa complex, contrary to S239D, I332E, and A330L, it is thought that S298 interacts with FcγR only in the $H_B$ chain as shown in FIG. 23 (JBC, 276: 16469-16477, 2001). Thus, it is thought that, when an alteration is introduced at S298, the residue after substitution mutation also interacts with FcγRIIIa on the HB chain side. As seen in Example 5, L234Y and G236W are thought to enhance the interaction with FcγR from the same direction as S298A. That is, it is thought that, when S239D, A330L, and I332E are introduced into the same H chain, and L234Y, G236W, and S298A are introduced into the other H chain, all of the introduced alterations can interact with FcγR at the same time, resulting in further enhancement of the interaction with FcγR.

To assess the above hypothesis, the present inventors carried out the following experiments. The direction of FcγR recognition by each alteration was determined according to the method described in Example 5, using antibodies having an H chain introduced with the alteration L234Y, G236W, S298A, S239D, A330L, or I332E, and P329R introduced into the same or different H chain. Expression vectors inserted with the following were constructed according to the method described in Reference Example 1: GpH7-A5; GpH7-A48 (SEQ ID NO: 16) resulting from the introduction of P329R into GpH7-A5; GpH7-HA7 (SEQ ID NO: 34) resulting from the introduction of S239D and P329R into GpH7-B3; GpH7-HA15 (SEQ ID NO: 35) resulting from the introduction of A330L and P329R into GpH7-B3; GpH7-HA18 (SEQ ID NO: 36) resulting from the introduction of I332E and P329R into GpH7-B3; GpH7-HA5 (SEQ ID NO: 19) resulting from the introduction of L234Y and P329R into GpH7-B3; GpH7-HA6 (SEQ ID NO: 20) resulting from the introduction of G236W and P329R into GpH7-B3; GpH7-HA11 (SEQ ID NO: 21) resulting from the introduction of S298A and P329R into GpH7-B3; GpH7-B3-06-09D (SEQ ID NO: 37) resulting from the introduction of S239D into GpH7-B3; GpH7-B3-20-08L (SEQ ID NO: 38) resulting from the introduction of A330L into GpH7-B3; GpH7-B3-22-10E (SEQ ID NO: 39) resulting from the introduction of I332E into GpH7-B3; GpH7-B3-01-15Y (SEQ ID NO: 22) resulting from the introduction of L234Y into GpH7-B3; GpH7-B3-03-20W (SEQ ID NO: 23) resulting from the introduction of G236W into GpH7-B3; and GpH7-B3-15-02A (SEQ ID NO: 24) resulting from the introduction of S298A into GpH7-B3. The expression vectors for the respective H chains were combined in a way that each of the alterations L234Y, G236W, S298A, S239D, A330L, and I332E is present in the same H chain as P329R or in the different H chain from P329R, and the expression vector GpL16-k0 for the L chain was combined with them. Antibodies of interest were expressed and prepared according to the method described in Reference Example 1. The prepared antibodies were used to assay the FcγRIIIa-binding activity. The result of assessment using P329R on the direction of FcγRIIIa recognition by L234Y, G236W, S298A, S239D, A330L, and I332E is summarized in Table 12.

TABLE 12

| SAMPLE | H1 | MUTATION SITE | H2 | MUTATION SITE | | FcγRIIIa BINDING ACTIVITY |
|---|---|---|---|---|---|---|
| GpH7-A5/GpH7-HA7/GpL16-k0 (SEQ ID NO: 3, 34, 5) | A5 | — | HA7 | S239D | P329R | 3 |
| GpH7-A5/GpH7-HA15/GpL16-k0 (SEQ ID NO: 3, 35, 5) | A5 | — | HA15 | A330L | P329R | 32 |
| GpH7-A5/GpH7-HA18/GpL16-k0 (SEQ ID NO: 3, 36, 5) | A5 | — | HA18 | I332E | P329R | 35 |

TABLE 12-continued

| SAMPLE | H1 | MUTATION SITE | H2 | MUTATION SITE | | FcγRIIIa BINDING ACTIVITY |
|---|---|---|---|---|---|---|
| GpH7-A5/GpH7-HA5/GpL16-k0 (SEQ ID NO: 3, 19, 5) | A5 | — | HA5 | L234Y | P329R | 60 |
| GpH7-A5/GpH7-HA6/GpL16-k0 (SEQ ID NO: 3, 20, 5) | A5 | — | HA6 | G236W | P329R | 56 |
| GpH7-A5/GpH7-HA11/GpL16-k0 (SEQ ID NO: 3, 21, 5) | A5 | — | HA11 | S298A | P329R | 84 |
| GpH7-A48/GpH7-B3-06-09D/GpL16-k0 (SEQ ID NO: 16, 37, 5) | A48 | P329R | B3-06-09D | S239D | — | 123 |
| GpH7-A48/GpH7-B3-20-08L/GpL16-k0 (SEQ ID NO: 16, 38, 5) | A48 | P329R | B3-20-08L | A330L | — | 60 |
| GpH7-A48/GpH7-B3-22-10E/GpL16-k0 (SEQ ID NO: 16, 39, 5) | A48 | P329R | B3-22-10E | I332E | — | 189 |
| GpH7-A48/GpH7-B3-01-15Y/GpL16-k0 (SEQ ID NO: 16, 22, 5) | A48 | P329R | B3-01-15Y | L234Y | — | 11 |
| GpH7-A48/GpH7-B3-03-20W/GpL16-k0 (SEQ ID NO: 16, 23, 5) | A48 | P329R | B3-03-20W | G236W | — | 13 |
| GpH7-A48/GpH7-B3-15-02A/GpL16-k0 (SEQ ID NO: 16, 24, 5) | A48 | P329R | B3-15-02A | S298A | — | 47 |

The column "SAMPLE" indicates antibody names; the columns "H1" and "H2" indicate names of the H chain constant region of respective antibodies; and the column "MUTATION SITE" indicates mutations that are different in comparison with GpH7-A5/GpH7-B3/GpL16-k0 ("-": when there is no particular mutation). The FcγRIIIa-binding activity is indicated as a relative binding activity when setting the FcγRIIIa binding of GpH7-A5/GpH7-B3/GpL16-k0 as 100. The SEQ ID NOs are also shown for the amino acid sequences of the H chain and L chain of each antibody.

Based on the result, as to each altercation, the FcγRIIIa-binding activity is compared between when each alteration is introduced into the same H chain as P329R, and when introduced into the different H chain from P329R. In the case of S239D, the binding activity of GpH7-A5/GpH7-HA7/GpL16-k0 corresponding to the former was 3, while the binding activity of GpH7-A48/GpH7-B3-06-09D/GpL16-k0 corresponding to the latter was 123; thus, the FcγRIIIa binding was inhibited when the alteration was introduced into the same H chain as P329R. In the case of A330L, the binding activity of GpH7-A5/GpH7-HA15/GpL16-k0 corresponding to the former was 32, while the binding activity of GpH7-A48/GpH7-B3-20-08L/GpL16-k0 corresponding to the latter was 60; thus, the FcγRIIIa binding was inhibited when the alteration was introduced into the same H chain as P329R. In the case of I332E, the binding activity of GpH7-A5/GpH7-HA18/GpL16-k0 corresponding to the former was 35, while the binding activity of GpH7-A48/GpH7-B3-22-10E/GpL16-k0 corresponding to the latter was 189; thus, the FcγRIIIa binding was inhibited when the alteration was introduced into the same H chain as P329R. As to all of the alterations, the FcγRIIIa binding was inhibited when the alteration was introduced into the same H chain as P329R, i.e., the former case. If the H chain introduced with P329R corresponded to the $H_A$ chain of FIG. 23, P329R is thought to inhibit the binding from the X-direction. Since combinations that significantly inhibit the binding are those when S239D, A330L, or I332E was introduced into the same H chain as P329R; that is, in this case, the alterations were introduced into the $H_A$ chain. Since the effect to enhance the FcγRIIIa binding was markedly inhibited when any of the alterations S239D, A330L, and I332E was introduced into the same H chain as P329R, all the alterations, when introduced into the HA chain, enhance the FcγRIIIa binding from the X-direction which is inhibited by P329R. Thus, it is thought that the FcγRIIIa binding can be further enhanced by introducing these alterations into the same H chain. Based on Example 5, it was considered that all of L234Y, G236W, and S298A, when introduced into the $H_B$ chain, enhance the binding from the X-direction. As discussed in Examples 5 and 6, one can find a method for appropriately combining respective alterations by combining them with P329R. Based on the above results, to enhance the FcγRIIIa binding from the X-direction as shown in FIG. 3, S239D, A330L, and I332E need to be introduced into the $H_A$ chain, whereas L234Y, G236W, and S298A need to be introduced into the $H_B$ chain. Thus, it was thought that the FcγRIIIa binding from the X-direction can be further enhanced by introducing the respective alteration groups into different H chains.

To assess the above hypothesis, expression vectors inserted with the following were constructed according to the method described in Reference Example 1:

GpH7-A57 (SEQ ID NO: 40) resulting from the introduction of all of S239D, A330L, and I332E into GpH7-A5;

GpH7-B78 (SEQ ID NO: 41) resulting from the introduction of all of S239D, A330L, and I332E into GpH7-B3;

GpH7-TA7 (SEQ ID NO: 31) resulting from the introduction of all of L234Y, G236W, and S298A into GpH7-A5; and GpH7-TA45 (SEQ ID NO: 32) resulting from the introduction of all of L234Y, G236W, and S298A into GpH7-B3.

Using the expression vectors, and GpH7-A5, GpH7-B3, and GpL16-k0, the following antibodies were expressed and prepared according to the method described in Reference Example 1:

hetero GpH7-TA7/GpH7-B78/GpL16-k0 in which one of the H chains has been introduced with L234Y, G236W, and S298A, and the other has been introduced with S239D, A330L, and I332E;

GpH7-TA7/GpH7-B3/GpL16-k0 in which only one of the H chains has been introduced with L234Y, G236W, and S298A;

GpH7-TA7/GpH7-TA45/GpL16-k0 in which both of the H chains have been introduced with L234Y, G236W, and S298A;

GpH7-A5/GpH7-B78/GpL16-k0 in which only one of the H chains has been introduced with S239D, A330L, and I332E; and GpH7-A57/GpH7-B78/GpL16-k0 in which both of the H chains have been introduced with S239D, A330L, and I332E. The prepared antibodies were compared for the FcγRIIIa-binding activity using, as an indicator, KD for FcγRIIIa that was determined according to the method described in Reference Example 2. The assessment result on the effect of the combination of L234Y, G236W, and S298A with S239D, A330L, and I332E is summarized in Table 13.

erodimerized antibody GpH7-TA7/GpH7-B3/GpL16-k0 in which one of the H chains was introduced with L234Y, G236W, and S298A was increased by 5.1 times. This result demonstrates that the group of the alterations S239D, A330L, and I332E has the stronger effect to increase the FcγRIIIa-binding activity.

TABLE 13

| SAMPLE | H1 | MUTATION SITE | | | H2 | MUTATION SITE | | | KD (M) | KD ratio 1 | KD ratio 2 |
|---|---|---|---|---|---|---|---|---|---|---|---|
| GpH7-G1d/GpL16-k0 (SEQ ID NO: 2, 5) | G1d | | | | G1d | | | | 1.2E−06 | 1 | |
| GpH7-A5/GpH7-B3/GpL16-k0 (SEQ ID NO: 3, 4, 5) | A5 | — | — | — | B3 | — | — | — | 1.6E−06 | 0.75 | 1 |
| GpH7-TA7/GpH7-B3/GpL16-k0 (SEQ ID NO: 31, 4, 5) | TA7 | L234Y | G236W | S298A | B3 | — | — | — | 3.2E−07 | 3.8 | 5.1 |
| GpH7-A5/GpH7-B78/GpL16-k0 (SEQ ID NO: 3, 41, 5) | A5 | — | — | — | B78 | S239D | A330L | I332E | 5.4E−08 | 23 | 30 |
| GpH7-A57/GpH7-B78/GpL16-k0 (SEQ ID NO: 40, 41, 5) | A57 | S239D | A330L | I332E | B78 | S239D | A330L | I332E | 6.2E−09 | 199 | 263 |
| GpH7-TA7/GpH7-TA45/GpL16-k0 (SEQ ID NO: 31, 32, 5) | TA7 | L234Y | G236W | S298A | TA45 | L234Y | G236W | S298A | 3.3E−06 | 0.37 | 0.49 |
| GpH7-TA7/GpH7-B78/GpL16-k0 (SEQ ID NO: 31, 41, 5) | TA7 | L234Y | G236W | S298A | B78 | S239D | A330L | I332E | 4.7E−09 | 261 | 347 |

The column "SAMPLE" indicates antibody names; the columns "H1" and "H2" indicate names of the H chain constant region of respective antibodies; and the column "MUTATION SITE" indicates mutations that are different in comparison with GpH7-A5/GpH7-B3/GpL16-k0 ("-": when there is no particular mutation). A value obtained by dividing KD of GpH7-G1d/GpL16-k0 for FcγRIIIa by the KD of each antibody is defined as "KD ratio 1", while a value obtained by dividing KD of GpH7-A5/GpH7-B3/GpL16-k0 for FcγRIIIa by the KD of each antibody was defined as "KD ratio 2". The SEQ ID NOs are also shown for the amino acid sequences of the H chain and L chain of each antibody.

In view of the result of Table 13, when GpH7-A5/GpH7-B3/GpL16-k0 in which D356K, H435R, and K439E were each introduced into one H chain is compared to GpH7-G1d/GpL16-k0 which is a native IgG1, the difference in the FcγRIIIa-binding activity is 0.75 times, and no significant difference was observed. Thus, it was thought that the alterations D356K, H435R, and K439E do not affect the FcγRIIIa-binding activity.

Each alteration was assessed for its effect on homodimerized antibodies that use the prior art. The FcγRIIIa-binding activity of the homodimerized antibody GpH7-A57/GpH7-B78/GpL16-k0 in which both of the H chains were introduced with S239D, A330L, and I332E was increased by about 260 times that of GpH7-A5/GpH7-B3/GpL16-k0. In contrast, the FcγRIIIa-binding activity of the homodimerized antibody GpH7-TA7/GpH7-TA45/GpL16-k0 in which both of the H chains was introduced with L234Y, G236W, and S298A was decreased to 0.49 times. This demonstrates that only the group of the alterations S239D, A330L, and I332E has the effect to enhance the FcγRIIIa-binding activity of homodimerized antibodies.

Heterodimerized antibodies in which only one of the H chains was introduced with each alteration group were assessed for the effect of each alteration group. The FcγRIIIa-binding activity of the heterodimerized antibody GpH7-A5/GpH7-B78/GpL16-k0 in which one of the H chains was introduced with S239D, A330L, and I332E was increased by about 30 times that of GpH7-A5/GpH7-B3/GpL16-k0, while the FcγRIIIa-binding activity of the het- Each alteration group was assessed for the difference in its effect between the homodimerized antibody and heterodimerized antibody. Regarding S239D, A330L, and I332E, the FcγRIIIa-binding activity of the heterodimerized antibody was increased by 30 times that of GpH7-A5/GpH7-B3/GpL16-k0, while the activity of the homodimerized antibody was increased by about 260 times, demonstrating that the alterations, when introduced into homodimerized antibodies, further increase the FcγRIIIa-binding activity. Meanwhile, regarding L234Y, G236W, and S298A, the FcγRIIIa-binding activity of the heterodimerized antibody was increased by 5.1 times that of GpH7-A5/GpH7-B3/GpL16-k0; nevertheless, the activity of the homodimerized antibody was decreased to 0.49 times. This result shows that the group of the alterations L234Y, G236W, and S298A, only in heterodimerized antibodies, has the effect to enhance the FcγRIIIa-binding activity, as discussed in Example 5.

It was demonstrated that, in homodimerized antibodies, only the group of the alterations S239D, A330L, and I332E has the effect to enhance the FcγRIIIa binding, and also in heterodimerized antibodies, the group of the alterations S239D, A330L, and I332E more strongly enhances the FcγRIIIa binding. Based on the conventional concept, if the combination of the group of the alterations S239D, A330L, and I332E with the group of the alterations L234Y, G236W is considered, it would be predicted that the effect to enhance the FcγRIIIa binding is the strongest in the homodimerized antibody GpH7-A57/GpH7-B78/GpL16-k0 in which both of the H chains are introduced with only the group of the alterations S239D, A330L, and I332E, which strongly enhance the FcγRIIIa binding of both heterodimerized antibody and homodimerized antibody. However, the FcγRIIIa-binding activity of the heterodimerized antibody GpH7-TA7/GpH7-B78/GpL16-k0 in which S239D, A330L, and I332E were introduced into one H chain and L234Y, G236W, and S298A were introduced into the other H chain was increased by about 350 times that of GpH7-A5/GpH7-B3/GpL16-k0; the effect to enhance the binding was stronger than that for the homodimerized antibody in which both of the H chains were introduced with S239D, A330L, and I332E. This supports the hypothesis that, when the group of the alterations S239D, A330L, and I332E, and the group of the alterations L234Y, G236W, and S298A are introduced into different H chains, all of the introduced alterations enhance the FcγRIIIa-binding activity in both the $H_A$ chain and $H_B$ chain, and the effect is greater than the case when the group of the alterations S239D, A330L, and I332E are introduced into both H chains.

That is, it is demonstrated that the use of heterodimerized antibodies, instead of conventional homodimerized antibodies, allows finer optimization of the asymmetric interaction between the Fc domain and FcγRIIIa to design Fc domains having stronger binding activity.

In view of FIG. 23, it was thought that A330L and I332E interact with FcγR only in the HA chain, while S239D interacts with FcγR in both the $H_A$ chain and $H_B$ chain. Indeed, KD for FcγRIIIa of the heterodimerized antibody GpH7-A5/GpH7-B78/GpL16-k0 in which only one of the H chains was introduced with S239D, A330L, and I332E was 5.4E-8, while the KD of the homodimerized antibody GpH7-A57/GpH7-B78/GpL16-k0 was 6.2E-9; thus, the FcγRIIIa-binding activity was increased by 8.7 times. If it is thought that the difference in the binding activity is due to the involvement of S239D in the enhancement of the binding in both H chains, this difference is thought to be eliminated by introducing S239D into both H chains. To assess this hypothesis, GpH7-A53 (SEQ ID NO: 42) resulting from the introduction of S239D into GpH7-A5 was constructed, and, this is combined with GpH7-B78 introduced with S239D, A330L, and I332E, and the expression and preparation were performed according to the method described in Reference Example 1. The effect of the combination of S239D and S239D, A330L, and I332E was assessed by comparing the FcγRIIIa binding between the heterodimerized and homodimerized antibodies with S239D, A330L, and I332E according to the method described in Reference Example 2 (Table 14).

KD of GpH7-A5/GpH7-B78/GpL16-k0 for FcγRIIIa by the KD of each antibody was defined as "KD ratio". The SEQ ID NOs are also shown for the amino acid sequences of the H chain and L chain of each antibody.

Table 14 shows that the FcγRIIIa-binding activity of GpH7-A53/GpH7-B78/GpL16-k0 in which one of the H chains was introduced with S239D, A330L, and I332E and the other was introduced with S239D was increased by 4.9 times that of GpH7-A5/GpH7-B78/GpL16-k0 in which only one of the H chains was introduced with S239D, A330L, and I332E; while the activity was decreased by only 1.8 times that of GpH7-A57/GpH7-B78/GpL16-k0 in which both of the H chains were introduced with S239D, A330L, and I332E. This result demonstrates that S239D interacts with FcγRIIIa in both H chains, as mentioned above for the hypothesis. It was thought that the interaction with FcγRIIIa can be further enhanced by introducing the above alteration.

The present inventors tested whether the FcγRIIIa-binding activity can be further increased by introducing S239D into the heterodimerized antibody GpH7-TA7/GpH7-B78/GpL16-k0 in which one of the H chains was introduced with L234Y, G236W, and S298A and the other was introduced with S239D, A330L, and I332E. GpH7-TA22 (SEQ ID NO: 43) was constructed by introducing S239D into GpH7-TA7, and then inserted into an expression vector; and the resulting expression vector was combined with GpL16-k0, and GpH7-B78 obtained by introducing S239D, A330L, and I332E into GpH7-B3; and the antibody of interest was expressed and prepared according to the method described in Reference Example 1. Furthermore, the heterodimerized antibody GpH7-TA22/GpH7-B78/GpL16-k0 was prepared

TABLE 14

| Sample | H1 | MUTATION SITE | | | H2 | MUTATION SITE | | | KD (M) | KD ratio |
|---|---|---|---|---|---|---|---|---|---|---|
| GpH7-A5/GpH7-B78/GpL16-k0 (SEQ ID NO: 3, 41, 5) | A5 | — | — | — | B78 | S239D | A330L | I332E | 5.4E-08 | 1 |
| GpH7-A53/GpH7-B78/GpL16-k0 (SEQ ID NO: 42, 41, 5) | A53 | S239D | — | — | B78 | S239D | A330L | I332E | 1.1E-08 | 4.9 |
| GpH7-A57/GpH7-B78/GpL16-k0 (SEQ ID NO: 40, 41, 5) | A57 | S239D | A330L | I332E | B78 | S239D | A330L | I332E | 6.2E-09 | 8.7 |

The column "SAMPLE" indicates antibody names; the columns "H1" and "H2" indicate names of the H chain constant region of respective antibodies; and the column "MUTATION SITE" indicates mutations that are different in comparison with GpH7-A5/GpH7-B3/GpL16-k0 ("-": when there is no particular mutation). A value obtained by dividing by introducing L234Y, G236W, S239D, and S298A into one H chain, and S239D, A330L, and I332E into the other H chain. To assess the effect of the combination of S239D with S239D, A330L, and I332E, the antibodies were compared for the FcγRIIIa-binding activity according to the method described in Reference Example 2 (Table 15).

TABLE 15

| Sample | H1 | MUTATION SITE | | H2 | MUTATION SITE | KD (M) | KD ratio |
|---|---|---|---|---|---|---|---|
| GpH7-TA7/GpH7-B78/GpL16-k0 (SEQ ID NO: 31, 41, 5) | TA7 | L234Y/G236W/S298A | — | B78 | S239D/A330L/I332E | 4.1E-09 | 1 |
| GpH7-TA22/GpH7-B78/GpL16-k0 (SEQ ID NO: 43, 41, 5) | TA22 | L234Y/G236W/S298A | S239D | B78 | S239D/A330L/I332E | 1.3E-09 | 3.2 |

The column "SAMPLE" indicates antibody names; the columns "H1" and "H2" indicate names of the H chain constant region of respective antibodies; and the column "MUTATION SITE" indicates mutations that are different in comparison with GpH7-A5/GpH7-B3/GpL16-k0 ("-": when there is no particular mutation). A value obtained by dividing KD of GpH7-TA7/GpH7-B78/GpL16-k0 for FcγRIIIa by the KD of each antibody was defined as "KD ratio". The SEQ ID NOs are also shown for the amino acid sequences of the H chain and L chain of each antibody.

Table 15 shows that the binding activity of GpH7-TA22/GpH7-B78/GpL16-k0 resulting from the introduction of S239D into the H chain that does not contain S239D in the heterodimerized antibody GpH7-TA7/GpH7-B78/GpL16-k0 in which one of the H chains was introduced with L234Y, G236W, and S298A and the other H chain with S239D, A330L, and I332E was increased by 3.2 times that of GpH7-TA7/GpH7-B78/GpL16-k0. This result demonstrates that the FcγRIIIa binding can be further enhanced by using S239D.

Then, the present inventors considered further introducing the alterations Y296W and K334G that enhance the FcγRIIIa binding, which were revealed as described in Example 4.

First, it was considered which H chain should be introduced with Y296W. GpH7-TA52 (SEQ ID NO: 44) resulting from the introduction of the mutation Y296W into GpH7-TA7 was constructed, and expressed and prepared in combination with GpH7-B78 according to the method described in Reference Example 1. Furthermore, GpH7-TA58 (SEQ ID NO: 45) resulting from the introduction of Y296W into GpH7-B78 was constructed, and expressed and prepared in combination with GpH7-TA22 according to the method described in Reference Example 1. To assess the effects of combinations with Y296W, the prepared antibodies were compared for the FcγRIIIa-binding activity according to the method described in Reference Example 2 (Table 16).

KD of GpH7-TA7/GpH7-B78/GpL16-k0 for FcγRIIIa by the KD of each antibody was defined as "KD ratio". The SEQ ID NOs are also shown for the amino acid sequences of the H chain and L chain of each antibody.

The result showed that Y296W, when introduced into the H chain different from that introduced with L234Y, G236W, and S298A, increased the FcγRIIIa-binding activity only by 1.2 times after introduction compared to before; while Y296W, when introduced into the same H chain, increased the FcγRIIIa-binding activity by 1.8 times that of GpH7-TA7/GpH7-B78/GpL16-k0. From this result, it is thought that Y296W, when introduced into the same H chain as L234Y, G236W, and S298A, has the effect to enhance the FcγRIIIa binding.

Then, GpH7-TA54 (SEQ ID NO: 46) resulting from the introduction of Y296W into GpH7-TA22 was constructed, and expressed and prepared in combination with GpH7-B78 according to the method described in Reference Example 1. Furthermore, GpH7-TA58 (SEQ ID NO: 45) resulting from the introduction of Y296W into GpH7-B78 was constructed, and expressed and prepared in combination with GpH7-TA22 according to the method described in Reference Example 1. To assess the effect of combination with Y296W, the prepared antibodies were compared for the FcγRIIIa-binding activity according to the method described in Reference Example 2 (Table 17).

TABLE 17

| Sample | H1 | MUTATION SITE | H2 | MUTATION SITE | | KD (M) | KD ratio |
|---|---|---|---|---|---|---|---|
| GpH7-TA22/GpH7-B78/GpL16-k0 (SEQ ID NO: 43, 41, 5) | TA22 | L234Y/G236W/S239D/S298A | — | B78 | S239D/A330L/I332E | — | 1.3E−09 | 1 |
| GpH7-TA22/GpH7-TA58/GpL16-k0 (SEQ ID NO: 43, 45, 5) | TA22 | L234Y/G236W/S239D/S298A | — | TA58 | S239D/A330L/I332E | Y296W | 1.3E−09 | 1.0 |
| GpH7-TA54/GpH7-B78/GpL16-k0 (SEQ ID NO: 46, 41, 5) | TA54 | L234Y/G236W/S239D/S298A | Y296W | B78 | S239D/A330L/I332E | — | 1.0E−09 | 1.3 |

The column "Sample" indicates antibody names; the columns "H1" and "H2" indicate names of the H chain constant region of respective antibodies; and the column "MUTATION SITE" indicates mutations that are different in comparison with GpH7-A5/GpH7-B3/GpL16-k0 ("-": when there is no particular mutation). A value obtained by dividing KD of GpH7-TA22/GpH7-B78/GpL16-k0 for FcγRIIIa by the KD of each antibody was defined as "KD ratio". The SEQ ID NOs are also shown for the amino acid sequences of the H chain and L chain of each antibody.

The result shown in Table 17 demonstrates that, when Y296W was introduced into the H chain that is different

TABLE 16

| Sample | H1 | MUTATION SITE | | H2 | MUTATION SITE | | KD (M) | KD ratio |
|---|---|---|---|---|---|---|---|---|
| GpH7-TA7/GpH7-B78/GpL16-k0 (SEQ ID NO: 31, 41, 5) | TA7 | L234Y/G236W/S298A | — | B78 | S239D/A330L/I332E | — | 4.1E−09 | 1 |
| GpH7-TA7/GpH7-TA58/GpL16-k0 (SEQ ID NO: 31, 45, 5) | TA7 | L234Y/G236W/S298A | — | TA58 | S239D/A330L/I332E | Y296W | 3.3E−09 | 1.2 |
| GpH7-TA52/GpH7-B78/GpL16-k0 (SEQ ID NO: 44, 41, 5) | TA52 | L234Y/G236W/S298A | Y296W | B78 | S239D/A330L/I332E | — | 2.3E−09 | 1.8 |

The column "Sample" indicates antibody names; the columns "H1" and "H2" indicate names of H chain constant region of respective antibodies; and the column "MUTATION SITE" indicates mutations that are different in comparison with GpH7-A5/GpH7-B3/GpL16-k0 ("-": when there is no particular mutation). A value obtained by dividing from that introduced with L234Y, G236W, and S298A, there was no difference in the FcγRIIIa-binding activity after the introduction compared to before. When Y296W was introduced into the same H chain as L234Y, G236W, and S298A, the FcγRIIIa-binding activity was increased by 1.3 times that of GpH7-TA22/GpH7-B78/GpL16-k0. From this result, it was thought that Y296W, when introduced into the same H chain as L234Y, G236W, and S298A, has the effect to enhance the FcγRIIIa-binding activity.

Then, K334G was also assessed in the same manner. GpH7-TA40 (SEQ ID NO: 47) resulting from the introduction of K334G into GpH7-TA7 was constructed, and expressed and prepared in combination with GpH7-B78 according to the method described in Reference Example 1. Furthermore, GpH7-TA50 (SEQ ID NO: 48) resulting from the introduction of K334G into GpH7-B78 was constructed, and expressed and prepared in combination with GpH7-TA7 according to the method described in Reference Example 1. To assess the effect of combinations with K334G, the prepared antibodies were compared for the FcγRIIIa binding according to the method described in Reference Example 2 (Table 18).

in FIG. 24, alterations that allow an antibody to bind to activating FcγR more strongly than the native antibody, and bind to inhibitory FcγR more weakly than the native antibody, i.e., alterations that enhance the binding in an activating FcγR-selective manner. Also, the desirable alterations are, such as those in Region b shown in FIG. 25, alterations that allow the ratio between the binding activity to activating FcγR and the binding activity to inhibitory FcγR to be greater than the native antibody. It can be said that such alterations selectively increase the binding activity to activating FcγR as compared to inhibitory FcγR.

The heterodimerized antibodies He Abs in which one of the H chains was introduced with an alteration were assayed for their binding activities to each activating FcγR and inhibitory FcγR according to the method described in Example 4. The result is summarized in FIGS. 26, 27, 28 and

TABLE 18

| Sample | H1 | MUTATION SITE | H2 | MUTATION SITE | | KD (M) | KD ratio |
|---|---|---|---|---|---|---|---|
| GpH7-TA7/GpH7-B78/GpL16-k0 (SEQ ID NO: 31, 41, 5) | TA7 | L234Y/G236W/S298A | — | B78 | S239D/A330L/I332E | — | 4.1E−09 | 1.0 |
| GpH7-TA7/GpH7-TA50/GpL16-k0 (SEQ ID NO: 31, 48, 5) | TA7 | L234Y/G236W/S298A | — | TA50 | S239D/A330L/I332E | K334G | 3.4E−09 | 1.2 |
| GpH7-TA40/GpH7-B78/GpL16-k0 (SEQ ID NO: 47, 41, 5) | TA40 | L234Y/G236W/S298A | K334G | B78 | S239D/A330L/I332E | — | 7.5E−09 | 0.5 |

The column "Sample" indicates antibody names; the columns "H1" and "H2" indicate names of the H chain constant regions of each antibody; and the column "MUTATION SITE" indicates mutations that are different in comparison with GpH7-A5/GpH7-B3/GpL16-k0 ("-": when there is no particular mutation). A value obtained by dividing KD of GpH7-TA7/GpH7-B78/GpL16-k0 for FcγRIIIa by the KD of each antibody was defined as "KD ratio". The SEQ ID NOs are also shown for the amino acid sequences of the H chain and L chain of each antibody.

The result shown in Table 18 demonstrates that, when K334G was introduced into the same H chain as L234Y, G236W, and S298A, the FcγRIIIa-binding activity is decreased by half after the introduction compared to before. When K334G was introduced into the different H chain, the FcγRIIIa-binding activity was increased by 1.2 times that of GpH7-TA7/GpH7-B78/GpL16-k0. From this result, it was thought that K334G, when introduced into the H chain different from that introduced with L234Y, G236W, and S298A, has the effect to enhance the FcγRIIIa-binding activity.

[Example 8] Improvement of the Selectivity for Activating FcγR or Inhibitory FcγR There are activating FcγR which has ITAM, and inhibitory FcγR which has ITIM. Representative activating FcγRs (activating receptor) include FcγRIa, FcγRIIa, and FcγRIIIa, while representative inhibitory FcγRs (inhibitory receptor) include FcγRIIb. Regarding antibodies targeted to cancer, the ratio of the binding activity to activating FcγR whose action mechanism is based on ADCC activity or antibody-dependent cellular phagocytosis (ADCP) activity against the binding activity to inhibitory FcγR is believed to play an important role (Nature Medicine, 6: 443-446, 2000).

For antibodies targeted to cancer, it is desirable to increase their binding activity to activating FcγR while reducing their binding activity to inhibitory FcγR. Specifically, desirable alterations are, such as those comprised in Region a shown 29 to assess the ratio of the binding activity to each activating FcγR and inhibitory FcγR for each heterodimerized antibody. The activating FcγRs in FIGS. 26, 27, 28, and 29 are FcγRIa, FcγRIIa (R), FcγRIIa (H), and FcγRIIIa, respectively.

The alterations present in the region in FIG. 26 corresponding to a and b in FIGS. 24 and 25 are listed in Table 19 (Table 19-1 to 19-5). Likewise, as to FcγRIIa (R) (FIG. 27), FcγRIIa (H) (FIG. 28), FcγRIIIa (FIG. 29), alterations present in the region corresponding to a and b are listed in Table 20 (Table 20-1 to 20-3), Table 21 (Table 21-1 to 21-3), and Table 22 (Table 22-1 to 22-3).

TABLE 19-1

| REGION a Ia > Con IIb < Con | | |
|---|---|---|
| NAME | Ia binding He/Con__1a | IIb binding He/Con__2b |
| L234__03V | 104.4 | 73.1 |
| L234__04F | 101.0 | 99.8 |
| L234__06M | 103.8 | 78.5 |
| L234__07I | 102.9 | 80.9 |
| L234__15Y | 100.1 | 96.3 |
| G236__02A | 100.2 | 96.5 |
| G236__20W | 105.2 | 58.2 |
| S239__14T | 101.1 | 97.3 |
| S239__19Q | 100.6 | 86.1 |
| D265__10E | 101.4 | 38.2 |
| V266__19Q | 100.2 | 89.2 |
| S267__16H | 100.0 | 65.9 |
| S267__18N | 102.4 | 47.7 |
| H268__04F | 106.3 | 89.6 |
| H268__06M | 104.7 | 65.7 |
| H268__07I | 107.8 | 88.9 |
| H268__08L | 107.4 | 67.8 |
| H268__11K | 105.8 | 83.0 |
| H268__12R | 106.1 | 89.8 |
| H268__14T | 112.2 | 86.0 |
| E269__01G | 104.4 | 51.5 |
| E269__02A | 104.4 | 49.9 |

TABLE 19-1-continued

| | | |
|---|---|---|
| E269_03V | 102.6 | 45.1 |
| E269_04F | 103.1 | 45.0 |
| E269_05P | 102.3 | 52.6 |
| E269_06M | 103.6 | 46.7 |
| E269_07I | 102.8 | 43.9 |
| E269_08L | 103.6 | 42.9 |
| E269_13S | 103.1 | 47.8 |
| E269_14T | 105.9 | 50.6 |
| E269_15Y | 106.4 | 44.7 |
| E269_16H | 105.8 | 38.5 |
| E269_18N | 101.5 | 44.8 |
| E269_19Q | 105.0 | 44.3 |
| E269_20W | 105.2 | 42.5 |
| P271_02A | 103.5 | 88.0 |
| P271_03V | 102.3 | 74.8 |
| P271_04F | 101.8 | 59.5 |
| P271_06M | 102.5 | 77.5 |
| P271_07I | 102.5 | 76.8 |
| P271_11K | 102.8 | 90.2 |
| P271_12R | 102.4 | 86.5 |
| P271_13S | 102.4 | 87.6 |
| P271_14T | 102.3 | 95.4 |
| P271_15Y | 103.0 | 52.3 |
| P271_16H | 102.1 | 67.9 |
| P271_18N | 103.2 | 93.3 |
| P271_19Q | 103.1 | 88.6 |
| P271_20W | 102.6 | 58.1 |
| Q295_02A | 104.2 | 79.7 |
| Q295_03V | 104.1 | 75.7 |
| Q295_04F | 102.2 | 64.7 |
| Q295_05P | 103.4 | 67.5 |
| Q295_06M | 104.2 | 90.4 |
| Q295_07I | 103.0 | 84.3 |

REGION b
Ia/IIb => 1.2

| NAME | Ia binding He/Con_1a | IIb binding He/Con_2b | Ia/IIb He_1a/2b |
|---|---|---|---|
| L234_01G | 96.1 | 50.7 | 1.90 |
| L234_02A | 97.5 | 64.9 | 1.50 |
| L234_03V | 104.4 | 73.1 | 1.43 |
| L234_05P | 99.9 | 72.9 | 1.37 |
| L234_06M | 103.8 | 78.5 | 1.32 |
| L234_07I | 102.9 | 80.9 | 1.27 |
| L234_11K | 91.8 | 16.2 | 5.67 |
| L234_12R | 91.8 | 18.9 | 4.86 |
| L234_13S | 96.9 | 59.3 | 1.63 |
| L234_14T | 98.6 | 62.5 | 1.58 |
| L234_16H | 94.0 | 59.4 | 1.58 |
| L234_19Q | 95.7 | 60.3 | 1.59 |
| L235_01G | 87.2 | 35.4 | 2.46 |
| L235_02A | 92.2 | 63.0 | 1.46 |
| L235_03V | 94.7 | 66.4 | 1.43 |
| L235_05P | 94.7 | 54.7 | 1.73 |
| L235_06M | 98.0 | 81.0 | 1.21 |
| L235_11K | 79.9 | 6.3 | 12.73 |
| L235_12R | 78.0 | 9.6 | 8.12 |
| L235_13S | 90.5 | 48.2 | 1.88 |
| L235_14T | 88.7 | 46.8 | 1.90 |
| L235_18N | 92.2 | 54.9 | 1.68 |
| L235_19Q | 94.0 | 42.6 | 2.21 |
| G236_03V | 89.9 | 35.3 | 2.55 |
| G236_04F | 96.4 | 39.3 | 2.45 |
| G236_05P | 77.0 | 19.0 | 4.05 |
| G236_06M | 96.7 | 45.5 | 2.13 |
| G236_07I | 87.5 | 31.0 | 2.82 |
| G236_08L | 79.6 | 26.8 | 2.97 |
| G236_11K | 71.0 | 49.8 | 1.42 |
| G236_12R | 63.1 | 6.8 | 9.30 |
| G236_14T | 92.2 | 57.8 | 1.59 |
| G236_15Y | 92.5 | 39.5 | 2.34 |
| G236_16H | 83.5 | 27.9 | 2.99 |
| G236_19Q | 92.1 | 46.6 | 1.98 |
| G236_20W | 105.2 | 58.2 | 1.81 |
| G237_03V | 78.5 | 61.4 | 1.28 |
| G237_05P | 44.5 | 24.6 | 1.81 |
| G237_11K | 63.3 | 9.0 | 7.05 |
| G237_12R | 65.8 | 9.8 | 6.71 |
| G237_14T | 82.3 | 54.8 | 1.50 |
| G237_16H | 72.6 | 55.2 | 1.32 |
| P238_01G | 92.9 | 56.0 | 1.66 |
| P238_02A | 95.2 | 57.4 | 1.66 |
| P238_07I | 99.1 | 80.0 | 1.24 |
| P238_11K | 77.4 | 18.1 | 4.27 |
| P238_12R | 77.3 | 51.4 | 1.50 |
| P238_13S | 96.6 | 70.4 | 1.37 |
| P238_14T | 91.1 | 50.7 | 1.80 |
| P238_18N | 93.3 | 73.2 | 1.27 |
| S239_04F | 93.8 | 44.1 | 2.13 |
| S239_11K | 68.0 | 24.7 | 2.75 |
| S239_12R | 86.5 | 39.1 | 2.21 |
| S239_15Y | 89.8 | 34.9 | 2.57 |
| S239_16H | 88.1 | 49.4 | 1.78 |

TABLE 19-2

REGION a
Ia > Con
IIb < Con

| NAME | Ia binding He/Con_1a | IIb binding He/Con_2b |
|---|---|---|
| Q295_09D | 100.1 | 60.8 |
| Q295_10E | 103.1 | 94.8 |
| Q295_11K | 101.3 | 70.4 |
| Q295_12R | 100.4 | 65.2 |
| Q295_13S | 102.0 | 56.9 |
| Q295_14T | 102.7 | 66.8 |
| Q295_15Y | 101.7 | 65.4 |
| Q295_16H | 102.5 | 62.7 |
| Q295_18N | 102.4 | 64.9 |
| Y296_01G | 102.6 | 79.3 |
| Y296_02A | 102.9 | 82.0 |
| Y296_03V | 104.0 | 79.3 |
| Y296_04F | 104.1 | 99.2 |
| Y296_06M | 104.0 | 87.8 |
| Y296_07I | 104.3 | 84.3 |
| Y296_08L | 103.9 | 82.3 |
| Y296_09D | 105.9 | 98.9 |
| Y296_10E | 105.8 | 98.0 |
| Y296_11K | 104.7 | 72.8 |
| Y296_12R | 106.3 | 79.5 |
| Y296_13S | 105.1 | 86.3 |
| Y296_14T | 105.1 | 88.2 |
| Y296_16H | 105.8 | 92.2 |
| Y296_18N | 105.6 | 91.5 |
| Y296_19Q | 111.6 | 89.3 |
| S298_01G | 103.6 | 80.1 |
| S298_02A | 106.6 | 73.4 |
| S298_03V | 109.7 | 64.5 |
| S298_04F | 109.0 | 65.4 |
| S298_07I | 107.0 | 70.6 |
| S298_09D | 105.9 | 48.3 |
| S298_10E | 108.2 | 47.6 |
| S298_11K | 109.3 | 61.3 |
| S298_12R | 109.4 | 57.8 |
| S298_14T | 107.1 | 77.9 |
| S298_15Y | 107.2 | 61.4 |
| S298_16H | 108.8 | 63.5 |
| S298_18N | 108.1 | 48.1 |
| S298_19Q | 109.4 | 73.3 |
| S298_20W | 104.0 | 41.1 |
| Y300_01G | 116.1 | 48.4 |
| Y300_02A | 112.2 | 69.2 |
| Y300_03V | 117.0 | 73.9 |
| Y300_06M | 112.1 | 84.3 |
| Y300_07I | 107.8 | 74.5 |
| Y300_08L | 113.0 | 73.6 |
| Y300_09D | 112.5 | 93.2 |
| Y300_11K | 106.9 | 51.6 |
| Y300_12R | 104.6 | 41.2 |
| Y300_13S | 111.1 | 53.9 |
| Y300_14T | 111.7 | 55.6 |
| Y300_16H | 110.9 | 87.0 |

TABLE 19-2-continued

| Name | | |
|---|---|---|
| Y300_20W | 112.4 | 84.1 |
| K326_12R | 100.1 | 89.2 |
| S324_02A | 102.7 | 78.3 |
| S324_03V | 103.6 | 97.8 |
| S324_07I | 102.0 | 95.7 |

REGION b
Ia/IIb => 1.2

| NAME | Ia binding He/Con_1a | IIb binding He/Con_2b | Ia/IIb He_1a/2b |
|---|---|---|---|
| S239_20W | 92.7 | 45.1 | 2.06 |
| D265_01G | 79.9 | 16.1 | 4.95 |
| D265_02A | 84.5 | 19.9 | 4.25 |
| D265_03V | 55.7 | 3.2 | 17.30 |
| D265_04F | 53.0 | 3.2 | 16.77 |
| D265_06M | 75.7 | 10.0 | 7.57 |
| D265_07I | 54.4 | 1.3 | 41.18 |
| D265_08L | 56.8 | 4.6 | 12.43 |
| D265_10E | 101.4 | 38.2 | 2.66 |
| D265_11K | 43.2 | 14.9 | 2.90 |
| D265_12R | 44.3 | 15.0 | 2.96 |
| D265_13S | 68.7 | 11.3 | 6.07 |
| D265_14T | 78.5 | 16.0 | 4.90 |
| D265_15Y | 44.3 | 0.6 | 73.46 |
| D265_16H | 85.4 | 38.3 | 2.23 |
| D265_18N | 27.7 | 6.1 | 4.52 |
| D265_19Q | 88.8 | 33.4 | 2.66 |
| D265_20W | 51.5 | 1.1 | 45.61 |
| V266_01G | 91.3 | 51.5 | 1.77 |
| V266_04F | 96.7 | 57.6 | 1.68 |
| V266_05P | 71.9 | 0.4 | 205.21 |
| V266_09D | 79.3 | 10.1 | 7.88 |
| V266_10E | 81.9 | 15.2 | 5.37 |
| V266_11K | 64.4 | 1.0 | 63.53 |
| V266_13S | 90.6 | 54.4 | 1.67 |
| V266_15Y | 93.3 | 49.4 | 1.89 |
| V266_16H | 89.1 | 57.2 | 1.56 |
| V266_18N | 99.5 | 69.7 | 1.43 |
| V266_20W | 91.4 | 71.9 | 1.27 |
| S267_04F | 97.7 | 48.0 | 2.04 |
| S267_05P | 91.8 | 31.5 | 2.91 |
| S267_11K | 93.3 | 12.2 | 7.65 |
| S267_12R | 92.7 | 11.3 | 8.21 |
| S267_15Y | 94.2 | 37.9 | 2.48 |
| S267_16H | 100.0 | 65.9 | 1.52 |
| S267_18N | 102.4 | 47.7 | 2.15 |
| S267_20W | 99.4 | 57.2 | 1.74 |
| H268_06M | 104.7 | 65.7 | 1.59 |
| H268_07I | 107.8 | 88.9 | 1.21 |
| H268_08L | 107.4 | 67.8 | 1.58 |
| H268_11K | 105.8 | 83.0 | 1.28 |
| H268_14T | 112.2 | 86.0 | 1.30 |
| E269_01G | 104.4 | 51.5 | 2.03 |
| E269_02A | 104.4 | 49.9 | 2.09 |
| E269_03V | 102.6 | 45.1 | 2.27 |
| E269_04F | 103.1 | 45.0 | 2.29 |
| E269_05P | 102.3 | 52.6 | 1.94 |
| E269_06M | 103.6 | 46.7 | 2.22 |
| E269_07I | 102.8 | 43.9 | 2.34 |
| E269_08L | 103.6 | 42.9 | 2.42 |
| E269_11K | 95.2 | 17.8 | 5.34 |
| E269_12R | 97.1 | 25.2 | 3.86 |
| E269_13S | 103.1 | 47.8 | 2.16 |
| E269_14T | 105.9 | 50.6 | 2.09 |
| E269_15Y | 106.4 | 44.7 | 2.38 |
| E269_16H | 105.8 | 38.5 | 2.75 |
| E269_18N | 101.5 | 44.8 | 2.27 |

TABLE 19-3

REGION a
Ia > Con
IIb < Con

| NAME | Ia binding He/Con_1a | IIb binding He/Con_2b |
|---|---|---|
| S324_08L | 103.2 | 89.6 |
| S324_09D | 103.5 | 85.8 |
| S324_10E | 104.9 | 77.4 |
| S324_11K | 102.1 | 68.6 |
| S324_12R | 101.7 | 63.1 |
| S324_14T | 120.9 | 88.4 |
| S324_15Y | 113.8 | 88.2 |
| S324_16H | 112.6 | 83.5 |
| S324_18N | 115.5 | 81.1 |
| S324_19Q | 112.3 | 66.8 |
| S324_20W | 114.3 | 87.5 |
| A327_03V | 103.2 | 94.7 |
| A327_06M | 103.2 | 59.5 |
| A327_13S | 102.4 | 79.5 |
| P329_01G | 100.9 | 41.7 |
| P329_02A | 102.3 | 40.5 |
| A330_03V | 105.5 | 52.4 |
| A330_04F | 106.1 | 92.8 |
| A330_06M | 104.6 | 80.5 |
| A330_07I | 105.2 | 67.1 |
| A330_08L | 106.9 | 70.5 |
| A330_09D | 108.6 | 55.6 |
| A330_10E | 107.4 | 70.1 |
| A330_11K | 103.4 | 95.0 |
| A330_14T | 105.1 | 77.9 |
| A330_15Y | 105.0 | 95.0 |
| A330_16H | 105.8 | 87.5 |
| A330_18N | 106.5 | 63.7 |
| A330_19Q | 105.2 | 90.8 |
| A330_20W | 107.6 | 76.1 |
| I332_12R | 100.1 | 48.9 |
| E333_01G | 102.6 | 81.4 |
| E333_02A | 103.2 | 83.8 |
| E333_03V | 105.0 | 93.2 |
| E333_04F | 102.4 | 94.6 |
| E333_05P | 102.3 | 97.7 |
| E333_06M | 102.1 | 85.4 |
| E333_07I | 102.0 | 96.2 |
| E333_08L | 102.2 | 95.0 |
| E333_09D | 103.5 | 94.3 |
| E333_11K | 102.1 | 80.6 |
| E333_12R | 102.2 | 80.4 |
| E333_13S | 103.1 | 81.8 |
| E333_14T | 102.1 | 86.1 |
| E333_15Y | 101.2 | 94.4 |
| E333_16H | 100.8 | 83.3 |
| K334_01G | 103.5 | 92.5 |
| K334_09D | 106.5 | 94.8 |
| T335_01G | 104.4 | 96.7 |
| T335_02A | 103.3 | 94.0 |
| T335_05P | 106.4 | 99.9 |
| T335_06M | 106.7 | 99.4 |
| T335_11K | 110.8 | 91.0 |
| T335_12R | 112.8 | 91.9 |
| I336_01G | 108.7 | 90.1 |
| I336_02A | 106.0 | 84.9 |
| I336_03V | 105.2 | 90.3 |

REGION b
Ia/IIb => 1.2

| NAME | Ia binding He/Con_1a | IIb binding He/Con_2b | Ia/IIb He_1a/2b |
|---|---|---|---|
| E269_19Q | 105.0 | 44.3 | 2.37 |
| E269_20W | 105.2 | 42.5 | 2.47 |
| P271_03V | 102.3 | 74.8 | 1.37 |
| P271_04F | 101.8 | 59.5 | 1.71 |
| P271_06M | 102.5 | 77.5 | 1.32 |
| P271_07I | 102.5 | 76.8 | 1.33 |
| P271_15Y | 103.0 | 52.3 | 1.97 |
| P271_16H | 102.1 | 67.9 | 1.50 |
| P271_20W | 102.6 | 58.1 | 1.77 |

TABLE 19-3-continued

| NAME | | | |
|---|---|---|---|
| D270_01G | 76.3 | 30.5 | 2.50 |
| D270_02A | 71.5 | 48.3 | 1.48 |
| D270_03V | 77.9 | 39.5 | 1.97 |
| D270_04F | 78.1 | 53.1 | 1.47 |
| D270_05P | 67.1 | 13.9 | 4.81 |
| D270_06M | 78.8 | 48.2 | 1.64 |
| D270_07I | 74.6 | 41.5 | 1.80 |
| D270_08L | 73.5 | 53.6 | 1.37 |
| D270_11K | 58.4 | 20.3 | 2.88 |
| D270_12R | 66.3 | 18.3 | 3.63 |
| D270_13S | 75.3 | 44.2 | 1.70 |
| D270_14T | 70.6 | 57.8 | 1.22 |
| D270_15Y | 68.5 | 44.9 | 1.53 |
| D270_16H | 66.0 | 47.2 | 1.40 |
| D270_18N | 67.8 | 40.3 | 1.68 |
| D270_19Q | 78.2 | 48.0 | 1.63 |
| D270_20W | 68.0 | 34.7 | 1.96 |
| Q295_01G | 97.6 | 46.0 | 2.12 |
| Q295_02A | 104.2 | 79.7 | 1.31 |
| Q295_03V | 104.1 | 75.7 | 1.37 |
| Q295_04F | 102.2 | 64.7 | 1.58 |
| Q295_05P | 103.4 | 67.5 | 1.53 |
| Q295_07I | 103.0 | 84.3 | 1.22 |
| Q295_09D | 100.1 | 60.8 | 1.65 |
| Q295_11K | 101.3 | 70.4 | 1.44 |
| Q295_12R | 100.4 | 65.2 | 1.54 |
| Q295_13S | 102.0 | 56.9 | 1.79 |
| Q295_14T | 102.7 | 66.8 | 1.54 |
| Q295_15Y | 101.7 | 65.4 | 1.56 |
| Q295_16H | 102.5 | 62.7 | 1.64 |
| Q295_18N | 102.4 | 64.9 | 1.58 |
| Q295_20W | 93.7 | 44.4 | 2.11 |
| Y296_01G | 102.6 | 79.3 | 1.29 |
| Y296_02A | 102.9 | 82.0 | 1.26 |
| Y296_03V | 104.0 | 79.3 | 1.31 |
| Y296_05P | 95.6 | 36.6 | 2.61 |
| Y296_07I | 104.3 | 84.3 | 1.24 |
| Y296_08L | 103.9 | 82.3 | 1.26 |
| Y296_11K | 104.7 | 72.8 | 1.44 |
| Y296_12R | 106.3 | 79.5 | 1.34 |
| Y296_13S | 105.1 | 86.3 | 1.22 |
| Y296_19Q | 111.6 | 89.3 | 1.25 |
| S298_01G | 103.6 | 80.1 | 1.29 |
| S298_02A | 106.6 | 73.4 | 1.45 |
| S298_03V | 109.7 | 64.5 | 1.70 |
| S298_04F | 109.0 | 65.4 | 1.67 |
| S298_05P | 91.6 | 11.9 | 7.70 |
| S298_07I | 107.0 | 70.6 | 1.52 |

TABLE 19-4

REGION a
Ia > Con
IIb < Con

| NAME | Ia binding He/Con_1a | IIb binding He/Con_2b |
|---|---|---|
| I336_04F | 105.5 | 91.2 |
| I336_09D | 103.6 | 92.1 |
| I336_10E | 107.8 | 89.8 |
| I336_11K | 105.4 | 90.3 |
| I336_12R | 102.0 | 92.1 |
| I336_13S | 102.5 | 83.7 |
| I336_14T | 104.5 | 89.5 |
| I336_15Y | 102.9 | 68.2 |
| I336_16H | 101.4 | 85.8 |
| I336_18N | 107.8 | 97.6 |
| I336_19Q | 103.5 | 58.2 |
| S337_01G | 106.6 | 92.0 |
| S337_02A | 105.8 | 97.2 |
| S337_03V | 106.7 | 98.9 |
| S337_04F | 106.1 | 97.8 |
| S337_06M | 106.9 | 96.7 |
| S337_11K | 104.0 | 94.3 |

TABLE 19-4-continued

| NAME | | |
|---|---|---|
| S337_12R | 105.8 | 99.5 |
| S337_19Q | 104.6 | 99.7 |

REGION b
Ia/IIb => 1.2

| NAME | Ia binding He/Con_1a | IIb binding He/Con_2b | Ia/IIb He_1a/2b |
|---|---|---|---|
| S298_09D | 105.9 | 48.3 | 2.19 |
| S298_10E | 108.2 | 47.6 | 2.28 |
| S298_11K | 109.3 | 61.3 | 1.78 |
| S298_12R | 109.4 | 57.8 | 1.89 |
| S298_14T | 107.1 | 77.9 | 1.37 |
| S298_15Y | 107.2 | 61.4 | 1.75 |
| S298_16H | 108.8 | 63.5 | 1.71 |
| S298_18N | 108.1 | 48.1 | 2.25 |
| S298_19Q | 109.4 | 73.3 | 1.49 |
| S298_20W | 104.0 | 41.1 | 2.53 |
| Y300_01G | 116.1 | 48.4 | 2.40 |
| Y300_02A | 112.2 | 69.2 | 1.62 |
| Y300_03V | 117.0 | 73.9 | 1.58 |
| Y300_05P | 60.2 | 7.3 | 8.22 |
| Y300_06M | 112.1 | 84.3 | 1.33 |
| Y300_07I | 107.8 | 74.5 | 1.45 |
| Y300_08L | 113.0 | 73.6 | 1.54 |
| Y300_09D | 112.5 | 93.2 | 1.21 |
| Y300_11K | 106.9 | 51.6 | 2.07 |
| Y300_12R | 104.6 | 41.2 | 2.54 |
| Y300_13S | 111.1 | 53.9 | 2.06 |
| Y300_14T | 111.7 | 55.6 | 2.01 |
| Y300_16H | 110.9 | 87.0 | 1.27 |
| Y300_20W | 112.4 | 84.1 | 1.34 |
| N325_02A | 96.8 | 64.4 | 1.50 |
| N325_05P | 88.8 | 26.0 | 3.42 |
| N325_11K | 80.9 | 10.4 | 7.81 |
| N325_12R | 84.2 | 19.1 | 4.41 |
| N325_16H | 95.1 | 70.1 | 1.36 |
| N325_19Q | 99.1 | 69.1 | 1.43 |
| S324_01G | 98.8 | 81.1 | 1.22 |
| S324_02A | 102.7 | 78.3 | 1.31 |
| S324_09D | 103.5 | 85.8 | 1.21 |
| S324_10E | 104.9 | 77.4 | 1.35 |
| S324_11K | 102.1 | 68.6 | 1.49 |
| S324_12R | 101.7 | 63.1 | 1.61 |
| S324_14T | 120.9 | 88.4 | 1.37 |
| S324_15Y | 113.8 | 88.2 | 1.29 |
| S324_16H | 112.6 | 83.5 | 1.35 |
| S324_18N | 115.5 | 81.1 | 1.42 |
| S324_19Q | 112.3 | 66.8 | 1.68 |
| S324_20W | 114.3 | 87.5 | 1.31 |
| A327_04F | 99.1 | 63.7 | 1.56 |
| A327_05P | 99.3 | 69.3 | 1.43 |
| A327_06M | 103.2 | 59.5 | 1.74 |
| A327_08L | 98.6 | 63.1 | 1.56 |
| A327_11K | 86.1 | 12.5 | 6.87 |
| A327_12R | 86.7 | 9.0 | 9.64 |
| A327_13S | 102.4 | 79.5 | 1.29 |
| A327_15Y | 96.3 | 60.8 | 1.58 |
| A327_16H | 96.5 | 63.5 | 1.52 |
| A327_19Q | 96.2 | 54.2 | 1.78 |
| A327_20W | 97.7 | 73.8 | 1.24 |
| L328_01G | 97.2 | 80.2 | 1.21 |
| L328_05P | 92.2 | 65.1 | 1.42 |
| L328_11K | 79.2 | 7.5 | 10.52 |
| L328_12R | 78.6 | 9.2 | 8.51 |

TABLE 19-5

REGION b
Ia/IIb = >1.2

| NAME | Ia binding He/Con_1a | IIb binding He/Con_2b | Ia/IIb He_1a/2b |
|---|---|---|---|
| L328_18N | 98.7 | 80.8 | 1.22 |
| P329_01G | 100.9 | 41.7 | 2.42 |
| P329_02A | 102.3 | 40.5 | 2.52 |

TABLE 19-5-continued

REGION b
Ia/IIb = >1.2

| NAME | Ia binding He/Con_1a | IIb binding He/Con_2b | Ia/IIb He_1a/2b |
|---|---|---|---|
| P329_03V | 97.4 | 38.5 | 2.53 |
| P329_04F | 92.7 | 32.2 | 2.88 |
| P329_06M | 85.3 | 29.1 | 2.94 |
| P329_07I | 94.1 | 34.6 | 2.72 |
| P329_08L | 85.7 | 29.1 | 2.95 |
| P329_09D | 77.6 | 53.5 | 1.45 |
| P329_10E | 78.8 | 52.7 | 1.50 |
| P329_11K | 70.4 | 16.9 | 4.17 |
| P329_12R | 74.3 | 17.6 | 4.22 |
| P329_13S | 93.3 | 41.0 | 2.27 |
| P329_14T | 89.7 | 37.9 | 2.37 |
| P329_15Y | 95.6 | 45.7 | 2.09 |
| P329_16H | 95.6 | 39.1 | 2.45 |
| P329_18N | 92.4 | 40.4 | 2.29 |
| P329_19Q | 70.7 | 30.7 | 2.31 |
| P329_20W | 96.9 | 45.1 | 2.15 |
| A330_03V | 105.5 | 52.4 | 2.01 |
| A330_06M | 104.6 | 80.5 | 1.30 |
| A330_07I | 105.2 | 67.1 | 1.57 |
| A330_08L | 106.9 | 70.5 | 1.52 |
| A330_09D | 108.6 | 55.6 | 1.95 |
| A330_10E | 107.4 | 70.1 | 1.53 |
| A330_13S | 91.5 | 41.3 | 2.22 |
| A330_14T | 105.1 | 77.9 | 1.35 |
| A330_16H | 105.8 | 87.6 | 1.21 |
| A330_18N | 106.5 | 63.7 | 1.67 |
| A330_20W | 107.6 | 76.1 | 1.41 |
| P331_01G | 85.3 | 45.4 | 1.88 |
| I332_12R | 100.1 | 48.9 | 2.05 |
| E333_01G | 102.6 | 81.4 | 1.26 |
| E333_02A | 103.2 | 83.8 | 1.23 |
| E333_11K | 102.1 | 80.6 | 1.27 |
| E333_12R | 102.2 | 80.4 | 1.27 |
| E333_13S | 103.1 | 81.8 | 1.26 |
| E333_16H | 100.8 | 83.3 | 1.21 |
| E333_18N | 96.6 | 76.1 | 1.27 |
| T335_11K | 110.8 | 91.0 | 1.22 |
| T335_12R | 112.8 | 91.9 | 1.23 |
| I336_01G | 108.7 | 90.1 | 1.21 |
| I336_02A | 106.0 | 84.9 | 1.25 |
| I336_13S | 102.5 | 83.7 | 1.22 |
| I336_15Y | 102.9 | 68.2 | 1.51 |
| I336_19Q | 103.5 | 58.2 | 1.78 |
| I336_20W | 86.7 | 20.3 | 4.28 |

The table shows a list of alterations that selectively enhance the binding to FcγRIa as compared to FcγRIIb.

TABLE 20-1

REGION a
IIa > Con
IIb < Con

| NAME | IIaR binding He/Con_2aR | IIb binding He/Con_2b |
|---|---|---|
| L234_04F | 104

TABLE 20-1-continued

| | | | |
|---|---|---|---|
| G237_14T | 78.6 | 54.8 | 1.43 |
| G237_16H | 74.5 | 55.2 | 1.35 |
| P238_01G | 75.0 | 56.0 | 1.34 |
| P238_02A | 75.1 | 57.4 | 1.31 |
| P238_11K | 36.9 | 18.1 | 2.03 |
| P238_12R | 80.5 | 51.4 | 1.57 |
| P238_13S | 88.9 | 70.4 | 1.26 |
| P238_14T | 73.1 | 50.7 | 1.44 |
| P238_18N | 91.9 | 73.2 | 1.26 |
| S239_04F | 54.8 | 44.1 | 1.24 |
| S239_11K | 48.5 | 24.7 | 1.96 |
| S239_12R | 53.9 | 39.1 | 1.38 |
| S239_15Y | 42.2 | 34.9 | 1.21 |
| S239_16H | 69.2 | 49.4 | 1.40 |
| D265_01G | 24.1 | 16.1 | 1.49 |
| D265_02A | 33.9 | 19.9 | 1.71 |
| D265_03V | 5.8 | 3.2 | 1.80 |
| D265_04F | 5.6 | 3.2 | 1.79 |
| D265_06M | 15.8 | 10.0 | 1.58 |
| D265_07I | 3.4 | 1.3 | 2.57 |
| D265_08L | 6.6 | 4.6 | 1.46 |

TABLE 20-2

| | REGION b IIa/IIb = >1.2 | | |
|---|---|---|---|
| NAME | IIaR binding He/Con_2aR | IIb binding He/Con_2b | IIaR/IIb He_2aR/2b |
| D265_10E | 58.2 | 38.2 | 1.52 |
| D265_11K | 33.7 | 14.9 | 2.26 |
| D265_12R | 32.2 | 15.0 | 2.15 |
| D265_13S | 20.5 | 11.3 | 1.81 |
| D265_14T | 25.8 | 16.0 | 1.61 |
| D265_15Y | 4.6 | 0.6 | 7.57 |
| D265_16H | 58.0 | 38.3 | 1.51 |
| D265_18N | 12.4 | 6.1 | 2.02 |
| D265_19Q | 54.8 | 33.4 | 1.64 |
| D265_20W | 4.2 | 1.1 | 3.73 |
| V266_12R | −5.1 | −1.1 | 4.78 |
| V266_16H | 76.5 | 57.2 | 1.34 |
| H268_06M | 81.0 | 65.7 | 1.23 |
| H268_08L | 85.0 | 67.8 | 1.25 |
| H268_11K | 100.4 | 83.0 | 1.21 |
| E269_01G | 65.3 | 51.5 | 1.27 |
| E269_02A | 65.3 | 49.9 | 1.31 |
| E269_03V | 58.8 | 45.1 | 1.30 |
| E269_04F | 58.2 | 45.0 | 1.29 |
| E269_06M | 61.7 | 46.7 | 1.32 |
| E269_07I | 58.8 | 43.9 | 1.34 |
| E269_08L | 57.2 | 42.9 | 1.33 |
| E269_11K | 38.1 | 17.8 | 2.14 |
| E269_12R | 35.0 | 25.2 | 1.39 |
| E269_13S | 61.2 | 47.8 | 1.28 |
| E269_14T | 66.0 | 50.6 | 1.30 |
| E269_15Y | 57.6 | 44.7 | 1.29 |
| E269_16H | 50.7 | 38.5 | 1.32 |
| E269_18N | 59.2 | 44.8 | 1.32 |
| E269_19Q | 57.8 | 44.3 | 1.31 |
| E269_20W | 55.5 | 42.5 | 1.30 |
| P271_04F | 75.9 | 59.5 | 1.28 |
| P271_15Y | 70.7 | 52.3 | 1.35 |
| P271_20W | 77.3 | 58.1 | 1.33 |
| Q295_01G | 60.9 | 46.0 | 1.32 |
| Q295_03V | 91.2 | 75.7 | 1.20 |
| Q295_04F | 83.6 | 64.7 | 1.29 |
| Q295_05P | 87.4 | 67.5 | 1.30 |
| Q295_11K | 88.9 | 70.4 | 1.26 |
| Q295_12R | 83.0 | 65.2 | 1.27 |
| Q295_13S | 73.7 | 56.9 | 1.30 |
| Q295_15Y | 82.8 | 65.4 | 1.27 |
| Q295_16H | 81.3 | 62.7 | 1.30 |
| Q295_18N | 82.4 | 64.9 | 1.27 |
| Q295_20W | 60.0 | 44.4 | 1.35 |
| Y296_01G | 95.8 | 79.3 | 1.21 |
| Y296_03V | 96.2 | 79.3 | 1.21 |

TABLE 20-2-continued

| | REGION b IIa/IIb = >1.2 | | |
|---|---|---|---|
| NAME | IIaR binding He/Con_2aR | IIb binding He/Con_2b | IIaR/IIb He_2aR/2b |
| Y296_05P | 47.7 | 36.6 | 1.30 |
| Y296_11K | 94.3 | 72.8 | 1.30 |
| Y296_12R | 99.6 | 79.5 | 1.25 |
| S298_01G | 98.8 | 80.1 | 1.23 |
| S298_02A | 91.2 | 73.4 | 1.24 |
| S298_03V | 86.3 | 64.5 | 1.34 |
| S298_04F | 84.0 | 65.4 | 1.29 |
| S298_05P | 16.0 | 11.9 | 1.34 |
| S298_07I | 90.1 | 70.6 | 1.28 |
| S298_09D | 67.8 | 48.3 | 1.40 |

TABLE 20-3

| | REGION b IIa/IIb = >1.2 | | |
|---|---|---|---|
| NAME | IIaR binding He/Con_2aR | IIb binding He/Con_2b | IIaR/IIb He_2aR/2b |
| S298_10E | 65.1 | 47.6 | 1.37 |
| S298_11K | 95.1 | 61.3 | 1.55 |
| S298_12R | 85.3 | 57.8 | 1.48 |
| S298_14T | 98.5 | 77.9 | 1.26 |
| S298_15Y | 79.1 | 61.4 | 1.29 |
| S298_16H | 88.5 | 63.5 | 1.39 |
| S298_18N | 68.0 | 48.1 | 1.41 |
| S298_19Q | 95.0 | 73.3 | 1.30 |
| S298_20W | 55.4 | 41.1 | 1.35 |
| Y300_05P | 10.8 | 7.3 | 1.47 |
| Y300_12R | 55.1 | 41.2 | 1.34 |
| Y300_18N | 100.4 | 82.7 | 1.21 |
| N325_02A | 84.1 | 64.4 | 1.31 |
| N325_05P | 42.2 | 26.0 | 1.63 |
| N325_11K | 16.2 | 10.4 | 1.57 |
| N325_12R | 26.1 | 19.1 | 1.37 |
| N325_16H | 89.0 | 70.1 | 1.27 |
| N325_19Q | 92.1 | 69.1 | 1.33 |
| P329_01G | 55.0 | 41.7 | 1.32 |
| P329_02A | 58.9 | 40.5 | 1.45 |
| P329_03V | 53.8 | 38.5 | 1.40 |
| P329_04F | 44.7 | 32.2 | 1.39 |
| P329_06M | 42.7 | 29.1 | 1.47 |
| P329_07I | 49.6 | 34.6 | 1.44 |
| P329_08L | 42.8 | 29.1 | 1.47 |
| P329_09D | 67.8 | 53.5 | 1.27 |
| P329_10E | 64.8 | 52.7 | 1.23 |
| P329_11K | 30.2 | 16.9 | 1.79 |
| P329_12R | 29.3 | 17.6 | 1.66 |
| P329_13S | 61.5 | 41.0 | 1.50 |
| P329_14T | 57.3 | 37.9 | 1.51 |
| P329_15Y | 67.9 | 45.7 | 1.49 |
| P329_16H | 56.7 | 39.1 | 1.45 |
| P329_18N | 61.2 | 40.4 | 1.51 |
| P329_19Q | 41.1 | 30.7 | 1.34 |
| A330_03V | 74.9 | 52.4 | 1.43 |
| A330_07I | 85.6 | 67.1 | 1.27 |
| A330_08L | 88.8 | 70.5 | 1.26 |
| A330_09D | 70.9 | 55.6 | 1.27 |
| A330_10E | 86.6 | 70.1 | 1.23 |
| A330_12R | 103.5 | 84.8 | 1.22 |
| A330_13S | 60.8 | 41.3 | 1.47 |
| A330_14T | 95.5 | 77.9 | 1.23 |
| A330_18N | 81.1 | 63.7 | 1.27 |
| P331_01G | 61.0 | 45.4 | 1.34 |
| I336_20W | 30.3 | 20.3 | 1.50 |

The table shows a list of alterations that selectively enhance the binding to FcγRIIa (R) as compared to FcγRIIb.

TABLE 21-1

REGION a
IIaH > Con
IIb < Con

| NAME | IIaH binding He/Con__2aH | IIb binding He/Con__2b |
|---|---|---|
| L234__04F | 119.8 | 99.8 |
| L234__15Y | 120.2 | 96.3 |
| G236__02A | 139.2 | 96.5 |
| G236__03V | 119.4 | 35.3 |
| G236__04F | 117.8 | 39.3 |
| G236__07I | 115.2 | 31.0 |
| G236__13S | 134.9 | 96.7 |
| G236__14T | 103.2 | 57.8 |
| G236__15Y | 136.1 | 39.5 |
| G236__20W | 146.7 | 58.2 |
| H268__04F | 111.0 | 89.6 |
| D270__10E | 102.4 | 76.5 |
| Q295__05P | 103.3 | 67.5 |
| Q295__07I | 102.3 | 84.3 |
| Y296__04F | 100.1 | 99.2 |
| Y296__09D | 104.1 | 98.9 |
| Y296__16H | 103.7 | 92.2 |
| Y296__18N | 103.8 | 91.5 |
| Y300__06M | 104.8 | 84.3 |
| Y300__07I | 108.4 | 74.5 |
| Y300__08L | 108.2 | 73.6 |
| K326__12R | 100.6 | 89.2 |
| S324__02A | 102.4 | 78.3 |
| S324__04F | 101.4 | 89.1 |
| S324__09D | 105.7 | 85.8 |
| S324__10E | 102.8 | 77.4 |
| S324__15Y | 102.3 | 88.2 |
| S324__16H | 102.0 | 83.5 |
| S324__20W | 103.1 | 87.5 |
| A330__11K | 109.4 | 95.0 |
| A330__12R | 107.7 | 84.8 |
| A330__16H | 101.4 | 87.6 |
| A330__19Q | 102.2 | 90.8 |
| I332__03V | 104.7 | 80.7 |
| I332__13S | 109.5 | 98.4 |
| I332__16H | 109.2 | 93.0 |
| I332__18N | 110.0 | 89.9 |
| I332__19Q | 108.0 | 94.3 |
| E333__04F | 101.6 | 94.6 |
| E333__08L | 101.5 | 95.0 |
| E333__09D | 103.4 | 94.3 |
| E333__13S | 100.6 | 81.8 |
| E333__14T | 100.4 | 86.1 |
| T335__01G | 103.1 | 96.7 |
| T335__02A | 100.7 | 94.0 |
| T335__05P | 107.6 | 99.9 |
| T335__06M | 102.7 | 99.4 |
| I336__03V | 102.2 | 90.3 |
| I336__10E | 101.5 | 89.8 |
| I336__18N | 103.0 | 97.6 |

REGION b
IIaH/IIb => 1.2

| NAME | IIaH binding He/Con__2aH | IIb binding He/Con__2b | IIaH/IIb He__2aH/2b |
|---|---|---|---|
| L234__01G | 75.6 | 50.7 | 1.49 |
| L234__02A | 81.0 | 64.9 | 1.25 |
| L234__04F | 119.8 | 99.8 | 1.20 |
| L234__05P | 93.5 | 72.9 | 1.28 |
| L234__11K | 40.8 | 16.2 | 2.52 |
| L234__12R | 47.7 | 18.9 | 2.53 |
| L234__13S | 80.4 | 59.3 | 1.36 |
| L234__14T | 78.1 | 62.5 | 1.25 |
| L234__15Y | 120.2 | 96.3 | 1.25 |
| L234__16H | 87.3 | 59.4 | 1.47 |
| L234__19Q | 79.2 | 60.3 | 1.31 |
| L235__01G | 54.1 | 35.4 | 1.53 |
| L235__03V | 85.3 | 66.4 | 1.28 |
| L235__11K | 22.7 | 6.3 | 3.61 |
| L235__12R | 30.3 | 9.6 | 3.16 |
| L235__13S | 66.1 | 48.2 | 1.37 |
| L235__14T | 71.5 | 46.8 | 1.53 |
| L235__18N | 66.1 | 54.9 | 1.20 |
| L235__19Q | 62.0 | 42.6 | 1.45 |
| G236__02A | 139.2 | 96.5 | 1.44 |
| G236__03V | 119.4 | 35.3 | 3.39 |
| G236__04F | 117.8 | 39.3 | 3.00 |
| G236__05P | 63.5 | 19.0 | 3.34 |
| G236__06M | 85.7 | 45.5 | 1.88 |
| G236__07I | 115.2 | 31.0 | 3.72 |
| G236__08L | 75.8 | 26.8 | 2.83 |
| G236__12R | 34.2 | 6.8 | 5.04 |
| G236__13S | 134.9 | 96.7 | 1.39 |
| G236__14T | 103.2 | 57.8 | 1.79 |
| G236__15Y | 136.1 | 39.5 | 3.45 |
| G236__16H | 98.2 | 27.9 | 3.51 |
| G236__19Q | 89.1 | 46.6 | 1.91 |
| G236__20W | 146.7 | 58.2 | 2.52 |
| S239__11K | 48.1 | 24.7 | 1.94 |
| S239__12R | 57.1 | 39.1 | 1.46 |
| S239__16H | 59.4 | 49.4 | 1.20 |
| D265__02A | 31.3 | 19.9 | 1.58 |
| D265__03V | 4.6 | 3.2 | 1.42 |
| D265__04F | 4.1 | 3.2 | 1.28 |
| D265__06M | 13.5 | 10.0 | 1.35 |
| D265__07I | 3.1 | 1.3 | 2.35 |
| D265__11K | 27.8 | 14.9 | 1.87 |
| D265__12R | 28.0 | 15.0 | 1.87 |
| D265__13S | 19.8 | 11.3 | 1.75 |
| D265__14T | 24.1 | 16.0 | 1.50 |
| D265__15Y | 3.7 | 0.6 | 6.07 |
| D265__16H | 48.6 | 38.3 | 1.27 |
| D265__18N | 12.4 | 6.1 | 2.01 |
| D265__19Q | 47.7 | 33.4 | 1.43 |
| D265__20W | 3.2 | 1.1 | 2.86 |
| V266__05P | 0.7 | 0.4 | 1.91 |
| H268__04F | 111.0 | 89.6 | 1.24 |
| H268__06M | 84.8 | 65.7 | 1.29 |
| H268__08L | 85.0 | 67.8 | 1.25 |
| E269__01G | 71.5 | 51.5 | 1.39 |

TABLE 21-2

REGION b
IIaH/IIb = >1.2

| NAME | IIaH binding He/Con__2aH | IIb binding He/Con__2b | IIaH/IIb He__2aH/2b |
|---|---|---|---|
| E269__02A | 77.8 | 49.9 | 1.56 |
| E269__03V | 67.5 | 45.1 | 1.49 |
| E269__04F | 68.5 | 45.0 | 1.52 |
| E269__06M | 73.6 | 46.7 | 1.58 |
| E269__07I | 66.6 | 43.9 | 1.52 |
| E269__08L | 67.4 | 42.9 | 1.57 |
| E269__11K | 51.1 | 17.8 | 2.87 |
| E269__12R | 46.8 | 25.2 | 1.86 |
| E269__13S | 70.0 | 47.8 | 1.46 |
| E269__14T | 69.6 | 50.6 | 1.37 |
| E269__15Y | 70.4 | 44.7 | 1.57 |
| E269__16H | 59.0 | 38.5 | 1.53 |
| E269__18N | 64.4 | 44.8 | 1.44 |
| E269__19Q | 80.2 | 44.3 | 1.81 |
| E269__20W | 60.9 | 42.5 | 1.43 |
| P271__15Y | 64.6 | 52.3 | 1.24 |
| P271__20W | 77.4 | 58.1 | 1.33 |
| D270__01G | 52.5 | 30.5 | 1.72 |
| D270__02A | 76.4 | 48.3 | 1.58 |
| D270__03V | 61.8 | 39.5 | 1.56 |
| D270__04F | 75.4 | 53.1 | 1.42 |
| D270__06M | 74.4 | 48.2 | 1.54 |
| D270__07I | 64.0 | 41.5 | 1.54 |
| D270__08L | 75.8 | 53.6 | 1.41 |
| D270__10E | 102.4 | 76.5 | 1.34 |
| D270__11K | 44.0 | 20.3 | 2.17 |
| D270__12R | 39.5 | 18.3 | 2.16 |
| D270__13S | 71.2 | 44.2 | 1.61 |
| D270__14T | 75.3 | 57.8 | 1.30 |

TABLE 21-2-continued

REGION b
IIaH/IIb = >1.2

| NAME | IIaH binding He/Con_2aH | IIb binding He/Con_2b | IIaH/IIb He_2aH/2b |
|---|---|---|---|
| D270_15Y | 71.9 | 44.9 | 1.60 |
| D270_16H | 71.5 | 47.2 | 1.51 |
| D270_18N | 62.5 | 40.3 | 1.55 |
| D270_19Q | 85.0 | 48.0 | 1.77 |
| D270_20W | 60.2 | 34.7 | 1.74 |
| Q295_03V | 92.0 | 75.7 | 1.22 |
| Q295_05P | 103.3 | 67.5 | 1.53 |
| Q295_07I | 102.3 | 84.3 | 1.21 |
| Q295_11K | 89.4 | 70.4 | 1.27 |
| Q295_12R | 84.1 | 65.2 | 1.29 |
| Q295_13S | 69.4 | 56.9 | 1.22 |
| Q295_16H | 78.6 | 62.7 | 1.25 |
| Q295_20W | 55.6 | 44.4 | 1.25 |
| S298_03V | 85.1 | 64.5 | 1.32 |
| S298_07I | 86.9 | 70.6 | 1.23 |
| S298_10E | 58.0 | 47.6 | 1.22 |
| S298_14T | 98.5 | 77.9 | 1.26 |
| S298_16H | 82.1 | 63.5 | 1.29 |
| S298_18N | 61.6 | 48.1 | 1.28 |
| S298_19Q | 91.0 | 73.3 | 1.24 |
| S298_20W | 49.9 | 41.1 | 1.21 |
| Y300_01G | 74.4 | 48.4 | 1.54 |
| Y300_02A | 93.5 | 69.2 | 1.35 |
| Y300_03V | 98.0 | 73.9 | 1.33 |
| Y300_06M | 104.8 | 84.3 | 1.24 |
| Y300_07I | 108.4 | 74.5 | 1.45 |
| Y300_08L | 108.2 | 73.6 | 1.47 |
| Y300_11K | 66.9 | 51.6 | 1.30 |

TABLE 21-3

REGION b
IIaH/IIb = >1.2

| NAME | IIaH binding He/Con_2aH | IIb binding He/Con_2b | IIaH/IIb He_2aH/2b |
|---|---|---|---|
| Y300_12R | 55.4 | 41.2 | 1.34 |
| Y300_13S | 88.1 | 53.9 | 1.64 |
| Y300_14T | 94.1 | 55.6 | 1.69 |
| N325_11K | 16.1 | 10.4 | 1.55 |
| N325_12R | 29.9 | 19.1 | 1.56 |
| S324_01G | 98.8 | 81.1 | 1.22 |
| S324_02A | 102.4 | 78.3 | 1.31 |
| S324_09D | 105.7 | 85.8 | 1.23 |
| S324_10E | 102.8 | 77.4 | 1.33 |
| S324_11K | 92.2 | 68.6 | 1.34 |
| S324_12R | 96.5 | 63.1 | 1.53 |
| S324_16H | 102.0 | 83.5 | 1.22 |
| S324_18N | 97.8 | 81.1 | 1.21 |
| S324_19Q | 96.0 | 66.8 | 1.44 |
| A327_04F | 84.4 | 63.7 | 1.32 |
| A327_06M | 75.5 | 59.5 | 1.27 |
| A327_12R | 11.3 | 9.0 | 1.26 |
| A327_19Q | 67.3 | 54.2 | 1.24 |
| L328_11K | 32.2 | 7.5 | 4.27 |
| L328_12R | 42.5 | 9.2 | 4.60 |
| P329_01G | 54.9 | 41.7 | 1.32 |
| P329_02A | 65.7 | 40.5 | 1.62 |
| P329_03V | 60.4 | 38.5 | 1.57 |
| P329_04F | 44.5 | 32.2 | 1.38 |
| P329_06M | 43.7 | 29.1 | 1.50 |
| P329_07I | 53.8 | 34.6 | 1.56 |
| P329_08L | 45.4 | 29.1 | 1.56 |
| P329_11K | 46.2 | 16.9 | 2.74 |
| P329_12R | 46.4 | 17.6 | 2.63 |
| P329_13S | 67.3 | 41.0 | 1.64 |
| P329_14T | 62.4 | 37.9 | 1.65 |
| P329_15Y | 68.7 | 45.7 | 1.50 |
| P329_16H | 66.1 | 39.1 | 1.69 |
| P329_18N | 66.2 | 40.4 | 1.64 |

TABLE 21-3-continued

REGION b
IIaH/IIb = >1.2

| NAME | IIaH binding He/Con_2aH | IIb binding He/Con_2b | IIaH/IIb He_2aH/2b |
|---|---|---|---|
| P329_19Q | 38.7 | 30.7 | 1.26 |
| A330_03V | 79.7 | 52.4 | 1.52 |
| A330_07I | 87.3 | 67.1 | 1.30 |
| A330_08L | 87.6 | 70.5 | 1.24 |
| A330_12R | 107.7 | 84.8 | 1.27 |
| A330_13S | 65.4 | 41.3 | 1.58 |
| A330_14T | 94.5 | 77.9 | 1.21 |
| A330_18N | 81.6 | 63.7 | 1.28 |
| I332_03V | 104.7 | 80.7 | 1.30 |
| I332_12R | 87.8 | 48.9 | 1.80 |
| I332_18N | 110.0 | 89.9 | 1.22 |
| E333_01G | 97.7 | 81.4 | 1.20 |
| E333_11K | 98.1 | 80.6 | 1.22 |
| E333_13S | 100.6 | 81.8 | 1.23 |
| E333_18N | 96.2 | 76.1 | 1.26 |
| I336_19Q | 73.7 | 58.2 | 1.27 |
| I336_20W | 30.9 | 20.3 | 1.52 |

The table shows a list of alterations that selectively enhance the binding to FcγRIIa (H) as compared to FcγRII.

TABLE 22-1

| REGION a IIIa > Con IIb < Con | | |
|---|---|---|
| NAME | IIIa binding He/Con_3a | IIb binding He/Con_2b |
| L234_04F | 118.1 | 99.8 |
| L234_07I | 103.1 | 80.9 |
| L234_15Y | 130.2 | 96.3 |
| G236_15Y | 120.8 | 39.5 |
| G236_20W | 135.4 | 58.2 |
| D270_10E | 123.4 | 76.5 |
| Q295_02A | 105.6 | 79.7 |
| Q295_10E | 100.2 | 94.8 |
| Q295_14T | 114.7 | 66.8 |
| S298_02A | 160.0 | 73.4 |
| S298_03V | 109.3 | 64.5 |
| S298_14T | 112.6 | 77.9 |
| Y300_08L | 104.9 | 73.6 |
| S324_01G | 104.9 | 81.1 |
| S324_02A | 104.1 | 78.3 |
| S324_09D | 101.0 | 85.8 |
| S324_14T | 103.1 | 88.4 |
| S324_15Y | 101.4 | 88.2 |
| S324_16H | 103.7 | 83.5 |
| S324_20W | 101.8 | 87.5 |
| A330_03V | 100.9 | 52.4 |
| A330_04F | 147.1 | 92.8 |
| A330_06M | 141.6 | 80.5 |
| A330_07I | 103.0 | 67.1 |
| A330_08L | 124.5 | 70.5 |
| A330_15Y | 125.0 | 95.0 |
| A330_16H | 104.2 | 87.6 |
| A330_20W | 104.2 | 76.1 |
| I332_01G | 110.7 | 87.1 |
| I332_13S | 104.5 | 98.4 |
| I332_19Q | 110.5 | 94.3 |
| E333_02A | 105.4 | 83.8 |
| E333_03V | 103.0 | 93.2 |
| E333_04F | 101.1 | 94.6 |
| E333_09D | 112.1 | 94.3 |
| E333_13S | 102.7 | 81.8 |
| E333_16H | 103.0 | 83.3 |
| E333_20W | 100.9 | 89.5 |
| K334_01G | 121.3 | 92.5 |
| K334_09D | 159.7 | 94.8 |
| T335_05P | 104.9 | 99.9 |
| T335_06M | 101.5 | 99.4 |

TABLE 22-1-continued

| | | |
|---|---|---|
| I336_02A | 111.0 | 84.9 |
| I336_03V | 112.2 | 90.3 |
| I336_09D | 106.2 | 92.1 |
| I336_10E | 119.4 | 89.8 |
| I336_13S | 101.6 | 83.7 |
| I336_14T | 108.2 | 89.5 |
| I336_18N | 104.0 | 97.6 |
| S337_01G | 102.2 | 92.0 |
| S337_04F | 101.4 | 97.8 |

REGION b
IIIa/IIb => 1.2

| NAME | IIb binding He/Con_2b | IIIa binding He/Con_3a | IIIa/IIb He_3a/2b |
|---|---|---|---|
| L234_03V | 73.1 | 91.4 | 1.25 |
| L234_05P | 72.9 | 88.1 | 1.21 |
| L234_07I | 80.9 | 103.1 | 1.27 |
| L234_11K | 16.2 | 30.5 | 1.88 |
| L234_12R | 18.9 | 36.9 | 1.95 |
| L234_15Y | 96.3 | 130.2 | 1.35 |
| L234_16H | 59.4 | 79.5 | 1.34 |
| L234_19Q | 60.3 | 79.8 | 1.32 |
| L235_01G | 35.4 | 58.8 | 1.66 |
| L235_03V | 66.4 | 98.0 | 1.48 |
| L235_05P | 54.7 | 71.1 | 1.30 |
| L235_11K | 6.3 | 38.1 | 6.06 |
| L235_12R | 9.6 | 41.2 | 4.29 |
| L235_13S | 48.2 | 69.6 | 1.44 |
| L235_14T | 46.8 | 75.8 | 1.62 |
| L235_18N | 54.9 | 67.3 | 1.23 |
| L235_19Q | 42.6 | 70.5 | 1.65 |
| G236_03V | 35.3 | 57.7 | 1.64 |
| G236_04F | 39.3 | 87.0 | 2.21 |
| G236_05P | 19.0 | 37.1 | 1.95 |
| G236_07I | 31.0 | 59.7 | 1.93 |
| G236_08L | 26.8 | 32.5 | 1.21 |
| G236_12R | 6.8 | 12.5 | 1.84 |
| G236_15Y | 39.5 | 120.8 | 3.06 |
| G236_16H | 27.9 | 43.1 | 1.54 |
| G236_20W | 58.2 | 135.4 | 2.33 |
| H268_06M | 65.7 | 80.3 | 1.22 |
| E269_01G | 51.5 | 62.2 | 1.21 |
| E269_02A | 49.9 | 68.7 | 1.38 |
| E269_03V | 45.1 | 56.6 | 1.25 |
| E269_06M | 46.7 | 58.5 | 1.25 |
| E269_07I | 43.9 | 55.8 | 1.27 |
| E269_08L | 42.9 | 52.1 | 1.21 |
| E269_11K | 17.8 | 44.0 | 2.47 |
| E269_12R | 25.2 | 43.2 | 1.72 |
| E269_13S | 47.8 | 62.7 | 1.31 |
| E269_16H | 38.5 | 51.2 | 1.33 |
| E269_18N | 44.8 | 57.8 | 1.29 |
| E269_19Q | 44.3 | 65.0 | 1.47 |
| P271_20W | 58.1 | 74.1 | 1.28 |
| D270_01G | 30.5 | 38.5 | 1.26 |
| D270_03V | 39.5 | 60.3 | 1.52 |
| D270_06M | 48.2 | 66.3 | 1.38 |
| D270_07I | 41.5 | 69.6 | 1.68 |
| D270_08L | 53.6 | 71.8 | 1.34 |
| D270_10E | 76.5 | 123.4 | 1.61 |
| D270_11K | 20.3 | 41.0 | 2.02 |
| D270_12R | 18.3 | 28.8 | 1.58 |
| D270_13S | 44.2 | 56.7 | 1.28 |
| D270_15Y | 44.9 | 54.5 | 1.22 |
| D270_18N | 40.3 | 56.5 | 1.40 |
| D270_19Q | 48.0 | 81.9 | 1.70 |
| Q295_01G | 46.0 | 73.0 | 1.59 |
| Q295_02A | 79.7 | 105.6 | 1.32 |
| Q295_09D | 60.8 | 81.5 | 1.34 |

TABLE 22-2

REGION b
IIIa/IIb = >1.2

| NAME | IIb binding He/Con_2b | IIIa binding He/Con_3a | IIIa/IIb He_3a/2b |
|---|---|---|---|
| Q295_13S | 56.9 | 86.1 | 1.51 |
| Q295_14T | 66.8 | 114.7 | 1.72 |
| Q295_16H | 62.7 | 76.4 | 1.22 |
| Q295_18N | 64.9 | 81.6 | 1.26 |
| Y296_20W | 103.3 | 135.0 | 1.31 |
| S298_02A | 73.4 | 160.0 | 2.18 |
| S298_03V | 64.5 | 109.3 | 1.69 |
| S298_04F | 65.4 | 82.5 | 1.26 |
| S298_07I | 70.6 | 96.4 | 1.37 |
| S298_09D | 48.3 | 66.7 | 1.38 |
| S298_14T | 77.9 | 112.6 | 1.45 |
| S298_15Y | 61.4 | 85.6 | 1.39 |
| S298_16H | 63.5 | 76.5 | 1.20 |
| Y300_01G | 48.4 | 81.6 | 1.69 |
| Y300_07I | 74.5 | 95.1 | 1.28 |
| Y300_08L | 73.6 | 104.9 | 1.43 |
| Y300_13S | 53.9 | 73.9 | 1.37 |
| Y300_14T | 55.6 | 85.4 | 1.53 |
| S324_01G | 81.1 | 104.9 | 1.29 |
| S324_02A | 78.3 | 104.1 | 1.33 |
| S324_10E | 77.4 | 99.3 | 1.28 |
| S324_11K | 68.6 | 83.0 | 1.21 |
| S324_12R | 63.1 | 90.3 | 1.43 |
| S324_16H | 83.5 | 103.7 | 1.24 |
| S324_19Q | 66.8 | 88.5 | 1.33 |
| A327_11K | 12.5 | 31.7 | 2.53 |
| A327_12R | 9.0 | 19.3 | 2.15 |
| L328_11K | 7.5 | 33.5 | 4.46 |
| L328_12R | 9.2 | 32.7 | 3.53 |
| P329_02A | 40.5 | 56.4 | 1.39 |
| P329_11K | 16.9 | 29.6 | 1.76 |
| P329_12R | 17.6 | 26.7 | 1.52 |
| A330_03V | 52.4 | 100.9 | 1.93 |
| A330_04F | 92.8 | 147.1 | 1.59 |
| A330_06M | 80.5 | 141.6 | 1.76 |
| A330_07I | 67.1 | 103.0 | 1.53 |
| A330_08L | 70.5 | 124.5 | 1.77 |
| A330_10E | 70.1 | 84.6 | 1.21 |
| A330_15Y | 95.0 | 125.0 | 1.32 |
| A330_20W | 76.1 | 104.2 | 1.37 |
| I332_01G | 87.1 | 110.7 | 1.27 |
| I332_09D | 147.0 | 206.6 | 1.41 |
| I332_10E | 142.4 | 232.7 | 1.63 |
| I332_12R | 48.9 | 75.9 | 1.55 |
| E333_01G | 81.4 | 98.2 | 1.21 |
| E333_02A | 83.8 | 105.4 | 1.26 |
| E333_13S | 81.8 | 102.7 | 1.26 |
| E333_16H | 83.3 | 103.0 | 1.24 |
| K334_01G | 92.5 | 121.3 | 1.31 |
| K334_02A | 107.5 | 147.1 | 1.37 |
| K334_04F | 110.9 | 147.5 | 1.33 |
| K334_05P | 105.1 | 133.7 | 1.27 |
| K334_06M | 109.1 | 144.5 | 1.33 |
| K334_07I | 119.1 | 151.1 | 1.27 |
| K334_08L | 106.5 | 143.3 | 1.35 |
| K334_09D | 94.8 | 159.7 | 1.69 |

TABLE 22-3

REGION b
IIIa/IIb = >1.2

| NAME | IIb binding He/Con_2b | IIIa binding He/Con_3a | IIIa/IIb He_3a/2b |
|---|---|---|---|
| K334_10E | 114.5 | 180.6 | 1.58 |
| K334_13S | 110.9 | 145.3 | 1.31 |
| K334_14T | 115.4 | 141.4 | 1.23 |
| K334_15Y | 109.2 | 140.8 | 1.29 |
| K334_19Q | 109.3 | 136.1 | 1.25 |
| K334_20W | 103.8 | 127.8 | 1.23 |

TABLE 22-3-continued

REGION b
IIIa/IIb = >1.2

| NAME | IIb binding He/Con_2b | IIIa binding He/Con_3a | IIIa/IIb He_3a/2b |
|---|---|---|---|
| I336_02A | 84.9 | 111.0 | 1.31 |
| I336_03V | 90.3 | 112.2 | 1.24 |
| I336_10E | 89.8 | 119.4 | 1.33 |
| I336_13S | 83.7 | 101.6 | 1.21 |
| I336_14T | 89.5 | 108.2 | 1.21 |
| I336_15Y | 68.2 | 87.3 | 1.28 |
| I336_19Q | 58.2 | 92.5 | 1.59 |

The table shows a list of alterations that selectively enhance the binding to FcγRIIIa as compared to FcγRIIb.

On the other hand, FcγRIIb, the sole inhibitory FcγR, plays an important role in autoimmune diseases and inflammatory diseases (J. Exp. Med., 203, 2157-2164, 2006; J. immunol., 178, 3272-3280, 2007). It has also been shown that antibodies having an Fc domain with increased FcγRIIb-binding activity can be effective in treating autoimmune diseases caused by B cells (Mol. Immunology 45, 3926-3933, 2008). In the case of antibodies that aim at treating autoimmune diseases and inflammatory diseases, ADCC activity and ADCP activity via activating FcγR can aggravate the pathological conditions. Thus, it is desirable to increase the binding activity to inhibitory FcγR while reducing the binding activity to activating FcγR as much as possible. Specifically, like the alterations present in Region c in FIG. 24, alterations desirably have the effect to increase the binding activity to inhibitory FcγR as compared to the native antibody and to reduce the binding activity to activating FcγR. Such alterations can be said to be alterations that selectively enhance the binding activity to inhibitory FcγR compared to activating FcγR. Furthermore, like the alterations present in Region d in FIG. 25, alterations desirably have the effect to increase the ratio between the binding activity to inhibitory FcγR and the binding activity to activating FcγR as compared to the native antibody. Such alterations can be said to be alterations that selectively increase the binding activity to inhibitory FcγR as compared to activating FcγR.

Based on FIGS. 26, 27, 28, and 29 on the assessment of the ratio between the binding activity to inhibitory FcγR and activating FcγR for each of the above heterodimerized antibodies, for alterations shown in each figure, those present in Regions corresponding to c and d in FIGS. 24 and 25 are summarized as a list in Table 23 (Tables 23-1 and 23-2), Table 24 (Tables 24-1 and 24-2), Table 25 (Tables 25-1 to 25-3), Table 26 (Tables 26-1 to 26-4).

TABLE 23-1

REGION c
Ia > Con
IIb > Con

| NAME | Ia binding He/Con_1a | IIb binding He/Con_2b |
|---|---|---|
| L234_09D | 97.8 | 150.3 |
| L234_20W | 98.6 | 114.4 |
| L235_04F | 97.1 | 118.5 |
| L235_09D | 84.8 | 106.2 |
| L235_15Y | 97.1 | 149.1 |
| L235_20W | 92.8 | 147.3 |
| G236_09D | 96.6 | 167.0 |
| G236_10E | 93.7 | 110.2 |

TABLE 23-1-continued

| | | |
|---|---|---|
| G237_02A | 90.3 | 123.6 |
| G237_04F | 81.5 | 149.2 |
| G237_06M | 81.6 | 129.9 |
| G237_08L | 79.6 | 148.0 |
| G237_09D | 84.0 | 222.7 |
| G237_10E | 75.1 | 114.1 |
| G237_13S | 92.2 | 110.8 |
| G237_15Y | 79.6 | 152.5 |
| G237_18N | 82.5 | 180.2 |
| G237_19Q | 82.8 | 107.9 |
| G237_20W | 78.4 | 193.4 |
| P238_09D | 96.0 | 220.9 |
| P238_16H | 96.0 | 115.2 |
| P238_19Q | 97.6 | 110.1 |
| P238_20W | 99.9 | 122.7 |
| S239_03V | 95.9 | 108.4 |
| S239_05P | 85.3 | 101.5 |
| S239_06M | 99.0 | 100.9 |
| S239_07I | 97.8 | 106.8 |
| S239_08L | 99.8 | 140.3 |
| V266_06M | 99.7 | 251.2 |
| V266_07I | 99.3 | 152.4 |
| V266_08L | 98.1 | 236.4 |
| S267_07I | 100.0 | 192.4 |
| A327_01G | 99.0 | 115.5 |
| N325_01G | 97.1 | 100.7 |
| N325_03V | 95.6 | 111.1 |
| N325_04F | 93.2 | 143.2 |
| N325_06M | 97.6 | 217.0 |
| N325_07I | 94.8 | 171.4 |
| N325_08L | 97.5 | 196.6 |
| N325_09D | 99.9 | 124.3 |
| N325_13S | 96.8 | 177.2 |
| N325_20W | 93.8 | 168.8 |
| S324_06M | 99.2 | 112.1 |
| A327_18N | 97.7 | 113.1 |
| L328_02A | 98.5 | 144.5 |
| L328_04F | 97.9 | 218.8 |
| L328_06M | 98.7 | 141.6 |
| L328_07I | 99.4 | 160.3 |
| L328_13S | 99.0 | 149.2 |
| P331_03V | 92.0 | 118.7 |
| P331_04F | 95.5 | 110.5 |
| P331_06M | 93.6 | 101.6 |
| P331_07I | 93.4 | 114.5 |
| P331_10E | 95.0 | 115.5 |
| P331_15Y | 96.0 | 114.4 |

REGION d
Ia/IIb =< 0.8

| NAME | Ia binding He/Con_1a | IIb binding He/Con_2b | Ia/IIb He_1a/2b |
|---|---|---|---|
| L234_09D | 97.8 | 150.3 | 0.65 |
| L235_09D | 84.8 | 106.2 | 0.80 |
| L235_15Y | 97.1 | 149.1 | 0.65 |
| L235_20W | 92.8 | 147.3 | 0.63 |
| G236_09D | 96.6 | 167.0 | 0.58 |
| G237_02A | 90.3 | 123.6 | 0.73 |
| G237_04F | 81.5 | 149.2 | 0.55 |
| G237_06M | 81.6 | 129.9 | 0.63 |
| G237_08L | 79.6 | 148.0 | 0.54 |
| G237_09D | 84.0 | 222.7 | 0.38 |
| G237_10E | 75.1 | 114.1 | 0.66 |
| G237_15Y | 79.6 | 152.5 | 0.52 |
| G237_18N | 82.5 | 180.2 | 0.46 |
| G237_19Q | 82.8 | 107.9 | 0.77 |
| G237_20W | 78.4 | 193.4 | 0.41 |
| P238_04F | 101.0 | 312.0 | 0.32 |
| P238_06M | 102.3 | 174.0 | 0.59 |
| P238_08L | 100.9 | 204.5 | 0.49 |
| P238_09D | 96.0 | 220.9 | 0.43 |
| P238_10E | 101.5 | 232.0 | 0.44 |
| P238_15Y | 100.9 | 217.8 | 0.46 |
| S239_01G | 101.3 | 144.2 | 0.70 |
| S239_08L | 99.8 | 140.3 | 0.71 |
| S239_09D | 101.0 | 205.8 | 0.49 |
| S239_10E | 105.2 | 180.6 | 0.58 |
| V266_06M | 99.7 | 251.2 | 0.40 |

TABLE 23-1-continued

| | | | |
|---|---|---|---|
| V266_07I | 99.3 | 152.4 | 0.65 |
| V266_08L | 98.1 | 236.4 | 0.42 |
| V266_12R | 59.2 | −1.1 | −55.61 |
| S267_02A | 108.9 | 243.3 | 0.45 |
| S267_03V | 106.0 | 192.3 | 0.55 |
| S267_06M | 105.9 | 209.5 | 0.51 |
| S267_07I | 100.0 | 192.4 | 0.52 |
| S267_09D | 109.7 | 310.5 | 0.35 |
| S267_10E | 105.8 | 379.3 | 0.28 |
| S267_19Q | 102.5 | 217.5 | 0.47 |
| H268_01G | 107.2 | 143.6 | 0.75 |
| H268_02A | 108.7 | 166.6 | 0.65 |
| H268_09D | 109.5 | 239.1 | 0.46 |
| H268_10E | 111.0 | 230.5 | 0.48 |
| H268_13S | 109.3 | 159.6 | 0.68 |
| H268_18N | 107.9 | 156.3 | 0.69 |
| P271_01G | 104.8 | 193.3 | 0.54 |
| K326_02A | 101.6 | 139.2 | 0.73 |
| K326_03V | 101.8 | 175.3 | 0.58 |
| K326_04F | 101.9 | 155.1 | 0.66 |
| K326_06M | 102.5 | 164.8 | 0.62 |
| K326_07I | 100.6 | 198.8 | 0.51 |
| K326_08L | 100.2 | 176.6 | 0.57 |
| K326_09D | 103.4 | 192.9 | 0.54 |
| K326_10E | 103.7 | 200.1 | 0.52 |
| K326_14T | 104.1 | 149.5 | 0.70 |
| K326_15Y | 105.9 | 159.4 | 0.66 |
| K326_19Q | 102.3 | 139.3 | 0.73 |
| K326_20W | 103.2 | 148.5 | 0.69 |

TABLE 23-2

REGION c
Ia > Con
IIb > Con

| NAME | Ia binding He/Con_1a | IIb binding He/Con_2b | |
|---|---|---|---|
| P331_16H | 92.4 | 116.0 | |
| P331_20W | 94.5 | 111.2 | |
| I332_02A | 88.3 | 103.3 | |
| I332_04F | 93.6 | 104.0 | |
| I332_06M | 92.3 | 104.7 | |
| I332_09D | 93.4 | 147.0 | |
| I332_10E | 96.3 | 142.4 | |
| I332_14T | 91.8 | 106.4 | |
| I332_15Y | 88.8 | 101.3 | |

REGION d
Ia/Iib =< 0.8

| NAME | Ia binding He/Con_1a | IIb binding He/Con_2b | Ia/IIb He_1a/2b |
|---|---|---|---|
| N325_04F | 93.2 | 143.2 | 0.65 |
| N325_06M | 97.6 | 217.0 | 0.45 |
| N325_07I | 94.8 | 171.4 | 0.55 |
| N325_08L | 97.5 | 196.6 | 0.50 |
| N325_13S | 96.8 | 177.2 | 0.55 |
| N325_20W | 93.8 | 168.8 | 0.56 |
| A327_09D | 102.8 | 171.7 | 0.60 |
| A327_10E | 103.4 | 140.5 | 0.74 |
| L328_02A | 98.5 | 144.5 | 0.68 |
| L328_04F | 97.9 | 218.8 | 0.45 |
| L328_06M | 98.7 | 141.6 | 0.70 |
| L328_07I | 99.4 | 160.3 | 0.62 |
| L328_09D | 101.6 | 198.8 | 0.51 |
| L328_10E | 101.2 | 172.2 | 0.59 |
| L328_13S | 99.0 | 149.2 | 0.66 |
| L328_14T | 100.4 | 141.3 | 0.71 |
| L328_15Y | 101.6 | 192.9 | 0.53 |
| L328_20W | 102.8 | 234.6 | 0.44 |
| A330_05P | 101.4 | 136.7 | 0.74 |
| P331_03V | 92.0 | 118.7 | 0.78 |
| P331_16H | 92.4 | 116.0 | 0.80 |

TABLE 23-2-continued

| | | | |
|---|---|---|---|
| I332_09D | 93.4 | 147.0 | 0.64 |
| I332_10E | 96.3 | 142.4 | 0.68 |

The table shows a list of alterations that selectively enhance the binding to FcγRIIb as compared to FcγRIa.

TABLE 24-1

REGION c
IIaR < Con
IIb > Con

| NAME | IIaR binding He/Con_2aR | IIb binding He/Con_2b |
|---|---|---|
| S239_03V | 99.9 | 108.4 |
| S267_08L | 72.1 | 108.7 |
| S267_14T | 81.9 | 104.4 |
| Y300_19Q | 99.7 | 108.3 |
| A327_01G | 98.2 | 115.5 |
| A327_07I | 98.0 | 126.7 |
| A327_18N | 88.9 | 113.1 |
| L328_19Q | 89.3 | 104.9 |
| I332_02A | 97.6 | 103.3 |

REGION d
IIaR/Iib =< 0.8

| NAME | IIaR binding He/Con_2aR | IIb binding He/Con_2b | IIaR/IIb He_2aR/2b |
|---|---|---|---|
| G236_09D | 106.1 | 167.0 | 0.64 |
| G237_09D | 155.6 | 222.7 | 0.70 |
| G237_20W | 138.3 | 193.4 | 0.71 |
| P238_04F | 174.4 | 312.0 | 0.56 |
| P238_08L | 139.7 | 204.5 | 0.68 |
| P238_09D | 148.2 | 220.9 | 0.67 |
| P238_10E | 151.3 | 232.0 | 0.65 |
| P238_15Y | 156.2 | 217.8 | 0.72 |
| S239_09D | 136.6 | 205.8 | 0.66 |
| S239_10E | 134.9 | 180.6 | 0.75 |
| V266_04F | 44.4 | 57.6 | 0.77 |
| V266_05P | −2.9 | 0.4 | −8.33 |
| V266_06M | 149.8 | 251.2 | 0.60 |
| V266_07I | 120.3 | 152.4 | 0.79 |
| V266_08L | 141.7 | 236.4 | 0.60 |
| V266_11K | −5.6 | 1.0 | −5.55 |
| S267_02A | 155.3 | 243.3 | 0.64 |
| S267_03V | 116.5 | 192.3 | 0.61 |
| S267_04F | 37.8 | 48.0 | 0.79 |
| S267_06M | 122.5 | 209.5 | 0.58 |
| S267_07I | 110.8 | 192.4 | 0.58 |
| S267_08L | 72.1 | 108.7 | 0.66 |
| S267_09D | 173.0 | 310.5 | 0.56 |
| S267_10E | 174.6 | 379.3 | 0.46 |
| S267_11K | 3.6 | 12.2 | 0.30 |
| S267_12R | 3.6 | 11.3 | 0.32 |
| S267_14T | 81.9 | 104.4 | 0.78 |
| S267_16H | 50.6 | 65.9 | 0.77 |
| S267_19Q | 135.2 | 217.5 | 0.62 |
| H268_02A | 133.2 | 166.6 | 0.80 |
| H268_09D | 149.3 | 239.1 | 0.62 |
| H268_10E | 147.7 | 230.5 | 0.64 |
| H268_13S | 127.3 | 159.6 | 0.80 |
| P271_01G | 144.0 | 193.3 | 0.75 |
| D270_05P | 7.5 | 13.9 | 0.54 |
| Y300_10E | 106.6 | 133.8 | 0.80 |
| K326_07I | 147.0 | 198.8 | 0.74 |
| K326_08L | 136.8 | 176.6 | 0.77 |
| K326_09D | 148.0 | 192.9 | 0.77 |
| K326_10E | 147.8 | 200.1 | 0.74 |
| N325_06M | 152.3 | 217.0 | 0.70 |
| N325_07I | 133.2 | 171.4 | 0.78 |
| N325_08L | 143.8 | 196.6 | 0.73 |
| N325_20W | 133.8 | 168.8 | 0.79 |
| A327_07I | 98.0 | 126.7 | 0.77 |
| A327_09D | 123.8 | 171.7 | 0.72 |
| A327_10E | 110.1 | 140.5 | 0.78 |

TABLE 24-1-continued

| | | | |
|---|---|---|---|
| A327_12R | 6.0 | 9.0 | 0.67 |
| A327_18N | 88.9 | 113.1 | 0.79 |
| L328_04F | 137.9 | 218.8 | 0.63 |
| L328_07I | 124.2 | 160.3 | 0.78 |
| L328_09D | 119.0 | 198.8 | 0.60 |
| L328_10E | 105.4 | 172.2 | 0.61 |
| L328_11K | 2.5 | 7.5 | 0.33 |
| L328_12R | 5.0 | 9.2 | 0.54 |

TABLE 24-2

REGION d
IIaR/IIb = <0.8

| NAME | IIaR binding He/Con_2aR | IIb binding He/Con_2b | IIaR/IIb He_2aR/2b |
|---|---|---|---|
| L328_13S | 116.6 | 149.2 | 0.78 |
| L328_15Y | 135.5 | 192.9 | 0.70 |
| L328_18N | 59.4 | 80.8 | 0.73 |
| L328_20W | 155.1 | 234.6 | 0.66 |
| I332_11K | 43.1 | 70.9 | 0.61 |

The table shows a list of alterations that selectively enhance the binding to FcγRIIb as compared to FcγRIIa(R).

TABLE 25-1

| REGION c<br>IIaH < Con<br>IIb > Con | | |
|---|---|---|
| NAME | IIaH binding He/Con__2aH | IIb binding He/Con__2b |
| L234__09D | 89.9 | 150.3 |
| L234__10E | 88.3 | 117.6 |
| L235__09D | 75.8 | 106.2 |
| G236__09D | 89.8 | 167.0 |
| G237__02A | 34.0 | 123.6 |
| G237__04F | 41.4 | 149.2 |
| G237__06M | 17.8 | 129.9 |
| G237__08L | 13.9 | 148.0 |
| G237__09D | 11.1 | 222.7 |
| G237__10E | 15.1 | 114.1 |
| G237__13S | 29.8 | 110.8 |
| G237__15Y | 25.4 | 152.5 |
| G237__18N | 15.2 | 180.2 |
| G237__19Q | 26.5 | 107.9 |
| G237__20W | 31.6 | 193.4 |
| P238__03V | 89.0 | 120.1 |
| P238__04F | 65.4 | 312.0 |
| P238__06M | 47.6 | 174.0 |
| P238__08L | 84.6 | 204.5 |
| P238__09D | 87.5 | 220.9 |
| P238__10E | 77.1 | 232.0 |
| P238__15Y | 59.8 | 217.8 |
| P238__16H | 45.9 | 115.2 |
| P238__19Q | 56.4 | 110.1 |
| P238__20W | 59.5 | 122.7 |
| S239__01G | 97.0 | 144.2 |
| S239__03V | 91.0 | 108.4 |
| S239__05P | 33.3 | 101.5 |
| S239__06M | 98.6 | 100.9 |
| S239__07I | 91.5 | 106.8 |
| S239__18N | 94.2 | 119.1 |
| V266__06M | 83.9 | 251.2 |
| S267__01G | 71.3 | 104.6 |
| S267__03V | 50.8 | 192.3 |
| S267__06M | 34.3 | 209.5 |
| S267__07I | 34.7 | 192.4 |
| S267__08L | 29.0 | 108.7 |
| S267__14T | 63.3 | 104.4 |
| S267__19Q | 61.3 | 217.5 |
| H268__01G | 99.2 | 143.6 |
| H268__03V | 99.2 | 113.9 |

TABLE 25-1-continued

| | | |
|---|---|---|
| H268__05P | 81.8 | 116.1 |
| H268__20W | 95.8 | 111.4 |
| P271__08L | 86.7 | 102.7 |
| P271__09D | 70.1 | 120.1 |
| P271__10E | 63.1 | 109.2 |
| Y296__20W | 97.6 | 103.3 |
| S298__06M | 98.1 | 101.8 |
| S298__08L | 85.0 | 108.5 |
| Y300__10E | 97.2 | 133.8 |
| Y300__19Q | 96.1 | 108.3 |
| K326__03V | 97.0 | 175.3 |
| K326__04F | 97.0 | 155.1 |
| K326__05P | 98.8 | 125.6 |
| K326__08L | 92.7 | 176.6 |

| REGION d<br>IIaH/Iib =< 0.8 | | | |
|---|---|---|---|
| NAME | IIaH binding He/Con__2aH | IIb binding He/Con__2b | IIaH/IIb He__2aH/2b |
| L234__09D | 89.9 | 150.3 | 0.60 |
| L234__10E | 88.3 | 117.6 | 0.75 |
| L235__09D | 75.8 | 106.2 | 0.71 |
| L235__20W | 117.7 | 147.3 | 0.80 |
| G236__09D | 89.8 | 167.0 | 0.54 |
| G237__02A | 34.0 | 123.6 | 0.27 |
| G237__03V | 39.4 | 61.4 | 0.64 |
| G237__04F | 41.4 | 149.2 | 0.28 |
| G237__05P | 9.5 | 24.6 | 0.39 |
| G237__06M | 17.8 | 129.9 | 0.14 |
| G237__08L | 13.9 | 148.0 | 0.09 |
| G237__09D | 11.1 | 222.7 | 0.05 |
| G237__10E | 15.1 | 114.1 | 0.13 |
| G237__11K | 5.8 | 9.0 | 0.64 |
| G237__12R | 7.5 | 9.8 | 0.76 |
| G237__13S | 29.8 | 110.8 | 0.27 |
| G237__14T | 31.8 | 54.8 | 0.58 |
| G237__15Y | 25.4 | 152.5 | 0.17 |
| G237__16H | 16.4 | 55.2 | 0.30 |
| G237__18N | 15.2 | 180.2 | 0.08 |
| G237__19Q | 26.5 | 107.9 | 0.25 |
| G237__20W | 31.6 | 193.4 | 0.16 |
| P238__01G | 37.3 | 56.0 | 0.66 |
| P238__03V | 89.0 | 120.1 | 0.74 |
| P238__04F | 65.4 | 312.0 | 0.21 |
| P238__06M | 47.6 | 174.0 | 0.27 |
| P238__07I | 57.6 | 80.0 | 0.72 |
| P238__08L | 84.6 | 204.5 | 0.41 |
| P238__09D | 87.5 | 220.9 | 0.40 |
| P238__10E | 77.1 | 232.0 | 0.33 |
| P238__13S | 50.9 | 70.4 | 0.72 |
| P238__14T | 37.7 | 50.7 | 0.74 |
| P238__15Y | 59.8 | 217.8 | 0.27 |
| P238__16H | 45.9 | 115.2 | 0.40 |
| P238__18N | 53.5 | 73.2 | 0.73 |
| P238__19Q | 56.4 | 110.1 | 0.51 |
| P238__20W | 59.5 | 122.7 | 0.49 |
| S239__01G | 97.0 | 144.2 | 0.67 |
| S239__05P | 33.3 | 101.5 | 0.33 |
| S239__08L | 104.8 | 140.3 | 0.75 |
| S239__09D | 114.4 | 205.8 | 0.56 |
| S239__10E | 112.0 | 180.6 | 0.62 |
| S239__18N | 94.2 | 119.1 | 0.79 |
| S239__20W | 35.2 | 45.1 | 0.78 |
| V266__01G | 36.7 | 51.5 | 0.71 |
| V266__04F | 25.3 | 57.6 | 0.44 |
| V266__06M | 83.9 | 251.2 | 0.33 |
| V266__07I | 105.5 | 152.4 | 0.69 |
| V266__08L | 104.5 | 236.4 | 0.44 |
| V266__09D | 6.4 | 10.1 | 0.63 |
| V266__10E | 10.1 | 15.2 | 0.66 |
| V266__12R | 1.1 | −1.1 | −1.05 |
| V266__13S | 27.0 | 54.4 | 0.50 |
| V266__14T | 43.3 | 82.3 | 0.53 |
| V266__15Y | 18.1 | 49.4 | 0.37 |

TABLE 25-2

REGION c
IIaH < Con
IIb > Con

| NAME | IIaH binding He/Con_2aH | IIb binding He/Con_2b |
|---|---|---|
| K326_15Y | 98.3 | 159.4 |
| K326_16H | 97.9 | 118.7 |
| K326_20W | 83.3 | 148.5 |
| A327_01G | 97.2 | 115.5 |
| N325_01G | 56.8 | 100.7 |
| N325_03V | 45.2 | 111.1 |
| N325_04F | 33.4 | 143.2 |
| N325_06M | 48.2 | 217.0 |
| N325_07I | 38.1 | 171.4 |
| N325_08L | 52.0 | 196.6 |
| N325_09D | 53.1 | 124.3 |
| N325_13S | 79.7 | 177.2 |
| N325_20W | 47.2 | 168.8 |
| A327_07I | 58.4 | 126.7 |
| A327_10E | 91.3 | 140.5 |
| A327_18N | 66.8 | 113.1 |
| L328_03V | 97.8 | 125.7 |
| L328_04F | 71.7 | 218.8 |
| L328_07I | 93.9 | 160.3 |
| L328_09D | 58.5 | 198.8 |
| L328_10E | 55.5 | 172.2 |
| L328_15Y | 90.0 | 192.9 |
| L328_19Q | 86.8 | 104.9 |
| A330_01G | 99.0 | 103.5 |
| A330_05P | 85.7 | 136.7 |
| P331_03V | 82.5 | 118.7 |
| P331_04F | 84.7 | 110.5 |
| P331_06M | 85.1 | 101.6 |
| P331_07I | 77.4 | 114.5 |
| P331_10E | 87.1 | 115.5 |
| P331_15Y | 86.0 | 114.4 |
| P331_16H | 84.5 | 116.0 |
| P331_20W | 82.8 | 111.2 |
| K334_02A | 97.0 | 107.5 |
| K334_05P | 97.6 | 105.1 |
| K334_10E | 98.2 | 114.5 |
| K334_12R | 99.7 | 111.2 |
| K334_18N | 99.7 | 114.8 |
| K334_20W | 97.6 | 103.8 |
| S337_15Y | 99.4 | 100.2 |
| S337_18N | 99.8 | 103.3 |

REGION d
IIaH/IIb =< 0.8

| NAME | IIaH binding He/Con_2aH | IIb binding He/Con_2b | IIaH/IIb He_2aH/2b |
|---|---|---|---|
| V266_16H | 21.2 | 57.2 | 0.37 |
| V266_19Q | 46.4 | 89.2 | 0.52 |
| V266_20W | 12.0 | 71.9 | 0.17 |
| S267_01G | 71.3 | 104.6 | 0.68 |
| S267_02A | 119.8 | 243.3 | 0.49 |
| S267_03V | 50.8 | 192.3 | 0.26 |
| S267_04F | 22.7 | 48.0 | 0.47 |
| S267_05P | 25.1 | 31.5 | 0.80 |
| S267_06M | 34.3 | 209.5 | 0.16 |
| S267_07I | 34.7 | 192.4 | 0.18 |
| S267_08L | 29.0 | 108.7 | 0.27 |
| S267_09D | 105.4 | 310.5 | 0.34 |
| S267_10E | 102.3 | 379.3 | 0.27 |
| S267_11K | 9.3 | 12.2 | 0.76 |
| S267_12R | 8.5 | 11.3 | 0.76 |
| S267_14T | 63.3 | 104.4 | 0.61 |
| S267_15Y | 19.6 | 37.9 | 0.52 |
| S267_16H | 29.8 | 65.9 | 0.45 |
| S267_19Q | 61.3 | 217.5 | 0.28 |
| S267_20W | 37.9 | 57.2 | 0.66 |
| H268_01G | 99.2 | 143.6 | 0.69 |
| H268_02A | 113.8 | 166.6 | 0.68 |
| H268_05P | 81.8 | 116.1 | 0.70 |
| H268_09D | 132.6 | 239.1 | 0.55 |
| H268_10E | 124.3 | 230.5 | 0.54 |
| H268_13S | 112.4 | 159.6 | 0.70 |
| H268_18N | 112.1 | 156.3 | 0.72 |
| H268_19Q | 102.4 | 132.8 | 0.77 |
| P271_01G | 107.0 | 193.3 | 0.55 |
| P271_09D | 70.1 | 120.1 | 0.58 |
| P271_10E | 63.1 | 109.2 | 0.58 |
| P271_14T | 60.9 | 95.4 | 0.64 |
| S298_08L | 85.0 | 108.5 | 0.78 |
| Y300_10E | 97.2 | 133.8 | 0.73 |
| K326_02A | 105.6 | 139.2 | 0.76 |
| K326_03V | 97.0 | 175.3 | 0.55 |
| K326_04F | 97.0 | 155.1 | 0.63 |
| K326_05P | 98.8 | 125.6 | 0.79 |
| K326_06M | 103.3 | 164.8 | 0.63 |
| K326_07I | 100.1 | 198.8 | 0.50 |
| K326_08L | 92.7 | 176.6 | 0.52 |
| K326_09D | 110.3 | 192.9 | 0.57 |
| K326_10E | 101.8 | 200.1 | 0.51 |
| K326_14T | 114.5 | 149.5 | 0.77 |
| K326_15Y | 98.3 | 159.4 | 0.62 |
| K326_19Q | 101.4 | 139.3 | 0.73 |
| K326_20W | 83.3 | 148.5 | 0.56 |
| N325_01G | 56.8 | 100.7 | 0.56 |
| N325_02A | 47.6 | 64.4 | 0.74 |
| N325_03V | 45.2 | 111.1 | 0.41 |
| N325_04F | 33.4 | 143.2 | 0.23 |
| N325_05P | 20.7 | 26.0 | 0.80 |
| N325_06M | 48.2 | 217.0 | 0.22 |
| N325_07I | 38.1 | 171.4 | 0.22 |
| N325_08L | 52.0 | 196.6 | 0.26 |
| N325_09D | 53.1 | 124.3 | 0.43 |
| N325_10E | 52.5 | 95.9 | 0.55 |

TABLE 25-3

REGION d
IIaH/IIb = <0.8

| NAME | IIaH binding He/Con_2aH | IIb binding He/Con_2b | IIaH/IIb He_2aH/2b |
|---|---|---|---|
| N325_13S | 79.7 | 177.2 | 0.45 |
| N325_14T | 62.7 | 91.6 | 0.68 |
| N325_15Y | 41.2 | 99.5 | 0.41 |
| N325_16H | 48.0 | 70.1 | 0.68 |
| N325_20W | 47.2 | 168.8 | 0.28 |
| S324_05P | 55.5 | 94.7 | 0.59 |
| A327_03V | 51.0 | 94.7 | 0.54 |
| A327_07I | 58.4 | 126.7 | 0.46 |
| A327_08L | 46.9 | 63.1 | 0.74 |
| A327_09D | 104.7 | 171.7 | 0.61 |
| A327_10E | 91.3 | 140.5 | 0.65 |
| A327_14T | 45.6 | 89.4 | 0.51 |
| A327_18N | 66.8 | 113.1 | 0.59 |
| L328_03V | 97.8 | 125.7 | 0.78 |
| L328_04F | 71.7 | 218.8 | 0.33 |
| L328_05P | 45.4 | 65.1 | 0.70 |
| L328_06M | 103.5 | 141.6 | 0.73 |
| L328_07I | 93.9 | 160.3 | 0.59 |
| L328_09D | 58.5 | 198.8 | 0.29 |
| L328_10E | 55.5 | 172.2 | 0.32 |
| L328_15Y | 90.0 | 192.9 | 0.47 |
| L328_20W | 112.6 | 234.6 | 0.48 |
| A330_05P | 85.7 | 136.7 | 0.63 |
| P331_03V | 82.5 | 118.7 | 0.70 |
| P331_04F | 84.7 | 110.5 | 0.77 |
| P331_07I | 77.4 | 114.5 | 0.68 |
| P331_10E | 87.1 | 115.5 | 0.75 |
| P331_15Y | 86.0 | 114.4 | 0.75 |
| P331_16H | 84.5 | 116.0 | 0.73 |
| P331_20W | 82.8 | 111.2 | 0.75 |
| I332_10E | 108.3 | 142.4 | 0.76 |

The table shows a list of alterations that selectively enhance the binding to FcγRIIb as compared to FcγRIIa(H).

TABLE 26-1

REGION c
IIIa < Con
IIb > Con

| NAME | IIIa binding He/Con__3a | IIb binding He/Con__2b |
|---|---|---|
| L235__04F | 79.1 | 118.5 |
| L235__09D | 91.6 | 106.2 |
| L235__15Y | 80.6 | 149.1 |
| L235__20W | 76.4 | 147.3 |
| G236__09D | 71.2 | 167.0 |
| G236__10E | 70.7 | 110.2 |
| G237__02A | 48.8 | 123.6 |
| G237__04F | 25.3 | 149.2 |
| G237__06M | 31.9 | 129.9 |
| G237__08L | 24.9 | 148.0 |
| G237__09D | 17.7 | 222.7 |
| G237__10E | 25.4 | 114.1 |
| G237__13S | 38.4 | 110.8 |
| G237__15Y | 22.1 | 152.5 |
| G237__18N | 20.3 | 180.2 |
| G237__19Q | 43.3 | 107.9 |
| G237__20W | 19.7 | 193.4 |
| P238__03V | 43.8 | 120.1 |
| P238__04F | 46.7 | 312.0 |
| P238__06M | 30.5 | 174.0 |
| P238__08L | 75.5 | 204.5 |
| P238__15Y | 64.5 | 217.8 |
| P238__16H | 30.7 | 115.2 |
| P238__19Q | 55.8 | 110.1 |
| P238__20W | 49.7 | 122.7 |
| S239__01G | 76.2 | 144.2 |
| S239__03V | 76.4 | 108.4 |
| S239__05P | 14.9 | 101.5 |
| S239__06M | 78.2 | 100.9 |
| S239__07I | 79.3 | 106.8 |
| S239__08L | 95.3 | 140.3 |
| V266__06M | 85.8 | 251.2 |
| S267__01G | 53.8 | 104.6 |
| S267__03V | 30.8 | 192.3 |
| S267__06M | 66.0 | 209.5 |
| S267__07I | 25.2 | 192.4 |
| S267__08L | 19.5 | 108.7 |
| S267__10E | 91.9 | 379.3 |
| S267__14T | 45.6 | 104.4 |
| S267__19Q | 65.0 | 217.5 |
| H268__01G | 96.7 | 143.6 |
| H268__03V | 92.3 | 113.9 |
| H268__05P | 76.4 | 116.1 |
| H268__15Y | 97.5 | 106.3 |
| H268__20W | 82.8 | 111.4 |
| P271__08L | 71.0 | 102.7 |
| P271__09D | 93.1 | 120.1 |
| P271__10E | 93.6 | 109.2 |
| S298__06M | 92.6 | 101.8 |
| S298__08L | 73.5 | 108.5 |
| Y300__19Q | 96.3 | 108.3 |
| K326__16H | 96.1 | 118.7 |
| K326__20W | 84.8 | 148.5 |
| A327__01G | 72.4 | 115.5 |
| N325__01G | 28.0 | 100.7 |

REGION d
IIIa/IIb =< 0.8

| NAME | IIb binding He/Con__2b | IIIa binding He/Con__3a | IIIa/IIb He__3a/2b |
|---|---|---|---|
| L234__09D | 150.3 | 116.8 | 0.78 |
| L235__04F | 118.5 | 79.1 | 0.67 |
| L235__15Y | 149.1 | 80.6 | 0.54 |
| L235__16H | 76.9 | 59.1 | 0.77 |
| L235__20W | 147.3 | 76.4 | 0.52 |
| G236__09D | 167.0 | 71.2 | 0.43 |
| G236__10E | 110.2 | 70.7 | 0.64 |
| G236__11K | 49.8 | 18.6 | 0.37 |
| G236__13S | 96.7 | 64.8 | 0.67 |
| G236__18N | 96.4 | 37.8 | 0.39 |
| G237__02A | 123.6 | 48.8 | 0.39 |
| G237__04F | 149.2 | 25.3 | 0.17 |
| G237__05P | 24.6 | 10.9 | 0.44 |
| G237__06M | 129.9 | 31.9 | 0.25 |
| G237__08L | 148.0 | 24.9 | 0.17 |
| G237__09D | 222.7 | 17.7 | 0.08 |
| G237__10E | 114.1 | 25.4 | 0.22 |
| G237__12R | 9.8 | 7.4 | 0.76 |
| G237__13S | 110.8 | 38.4 | 0.35 |
| G237__15Y | 152.5 | 22.1 | 0.14 |
| G237__16H | 55.2 | 17.2 | 0.31 |
| G237__18N | 180.2 | 20.3 | 0.11 |
| G237__19Q | 107.9 | 43.3 | 0.40 |
| G237__20W | 193.4 | 19.7 | 0.10 |
| P238__01G | 56.0 | 33.0 | 0.59 |
| P238__02A | 57.4 | 31.4 | 0.55 |
| P238__03V | 120.1 | 43.8 | 0.36 |
| P238__04F | 312.0 | 46.7 | 0.15 |
| P238__06M | 174.0 | 30.5 | 0.18 |
| P238__07I | 80.0 | 27.8 | 0.35 |
| P238__08L | 204.5 | 75.5 | 0.37 |
| P238__09D | 220.9 | 105.8 | 0.48 |
| P238__10E | 232.0 | 104.7 | 0.45 |
| P238__11K | 18.1 | 10.4 | 0.57 |
| P238__12R | 51.4 | 12.2 | 0.24 |
| P238__13S | 70.4 | 44.9 | 0.64 |
| P238__14T | 50.7 | 28.0 | 0.55 |
| P238__15Y | 217.8 | 64.5 | 0.30 |
| P238__16H | 115.2 | 30.7 | 0.27 |
| P238__18N | 73.2 | 40.4 | 0.55 |
| P238__19Q | 110.1 | 55.8 | 0.51 |
| P238__20W | 122.7 | 49.7 | 0.40 |
| S239__01G | 144.2 | 76.2 | 0.53 |
| S239__03V | 108.4 | 76.6 | 0.71 |
| S239__04F | 44.1 | 25.3 | 0.57 |
| S239__05P | 101.5 | 14.9 | 0.15 |
| S239__06M | 100.9 | 78.2 | 0.78 |
| S239__07I | 106.8 | 79.3 | 0.74 |
| S239__08L | 140.3 | 95.3 | 0.68 |
| S239__11K | 24.7 | 11.9 | 0.48 |
| S239__12R | 39.1 | 17.0 | 0.44 |
| S239__15Y | 34.9 | 25.6 | 0.73 |
| S239__16H | 49.4 | 29.2 | 0.59 |
| S239__19Q | 86.1 | 56.9 | 0.66 |
| D265__01G | 16.1 | 4.5 | 0.28 |

TABLE 26-2

REGION c
IIIa < Con
IIb > Con

| NAME | IIIa binding He/Con__3a | IIb binding He/Con__2b |
|---|---|---|
| N325__03V | 30.3 | 111.1 |
| N325__04F | 20.7 | 143.2 |
| N325__06M | 31.4 | 217.0 |
| N325__07I | 28.7 | 171.4 |
| N325__08L | 33.3 | 196.6 |
| N325__09D | 48.0 | 124.3 |
| N325__13S | 65.1 | 177.2 |
| N325__20W | 32.8 | 168.8 |
| A327__07I | 42.4 | 126.7 |
| A327__09D | 83.7 | 171.7 |
| A327__10E | 68.6 | 140.5 |
| A327__18N | 61.1 | 113.1 |
| L328__02A | 79.1 | 144.5 |
| L328__03V | 78.7 | 125.7 |
| L328__04F | 79.3 | 218.8 |
| L328__06M | 78.6 | 141.6 |
| L328__07I | 84.0 | 160.3 |
| L328__09D | 47.8 | 198.8 |
| L328__10E | 53.4 | 172.2 |
| L328__13S | 71.7 | 149.2 |
| L328__14T | 75.3 | 141.3 |
| L328__15Y | 68.3 | 192.9 |
| L328__19Q | 81.1 | 104.9 |

TABLE 26-2-continued

| NAME | IIb binding He/Con_2b | IIIa binding He/Con_3a | IIIa/IIb He_3a/2b |
|---|---|---|---|
| L328_20W | 37.4 | 234.6 | |
| A330_01G | 89.1 | 103.5 | |
| P331_03V | 73.2 | 118.7 | |
| P331_04F | 77.3 | 110.5 | |
| P331_06M | 74.8 | 101.6 | |
| P331_07I | 66.0 | 114.5 | |
| P331_10E | 75.1 | 115.5 | |
| P331_15Y | 81.9 | 114.4 | |
| P331_16H | 80.2 | 116.0 | |
| P331_20W | 78.6 | 111.2 | |
| I332_04F | 97.6 | 104.0 | |
| K334_12R | 90.8 | 111.2 | |
| T335_04F | 96.0 | 102.9 | |
| T335_18N | 98.8 | 101.6 | |
| S337_07I | 94.8 | 104.0 | |
| S337_08L | 96.9 | 100.2 | |

REGION d
IIIa/IIb =< 0.8

| NAME | IIb binding He/Con_2b | IIIa binding He/Con_3a | IIIa/IIb He_3a/2b |
|---|---|---|---|
| D265_02A | 19.9 | 7.4 | 0.37 |
| D265_03V | 3.2 | 0.6 | 0.19 |
| D265_04F | 3.2 | 0.0 | 0.00 |
| D265_06M | 10.0 | 2.6 | 0.26 |
| D265_07I | 1.3 | −0.8 | −0.61 |
| D265_08L | 4.6 | 0.0 | 0.00 |
| D265_10E | 38.2 | 20.1 | 0.53 |
| D265_11K | 14.9 | 2.5 | 0.17 |
| D265_12R | 15.0 | 3.2 | 0.21 |
| D265_13S | 11.3 | 3.9 | 0.35 |
| D265_14T | 16.0 | 4.3 | 0.27 |
| D265_15Y | 0.6 | −1.7 | −2.86 |
| D265_16H | 38.3 | 13.6 | 0.35 |
| D265_18N | 6.1 | 4.6 | 0.74 |
| D265_19Q | 33.4 | 8.5 | 0.25 |
| D265_20W | 1.1 | −0.5 | −0.48 |
| V266_01G | 51.5 | 24.0 | 0.47 |
| V266_02A | 81.0 | 57.4 | 0.71 |
| V266_04F | 57.6 | 34.7 | 0.60 |
| V266_05P | 0.4 | −0.7 | −1.98 |
| V266_06M | 251.2 | 85.8 | 0.34 |
| V266_07I | 152.4 | 114.1 | 0.75 |
| V266_08L | 236.4 | 118.0 | 0.50 |
| V266_09D | 10.1 | 2.7 | 0.27 |
| V266_10E | 15.2 | 4.1 | 0.27 |
| V266_11K | 1.0 | −0.7 | −0.70 |
| V266_13S | 54.4 | 28.1 | 0.52 |
| V266_14T | 82.3 | 39.4 | 0.48 |
| V266_15Y | 49.4 | 14.5 | 0.29 |
| V266_16H | 57.2 | 21.3 | 0.37 |
| V266_18N | 69.7 | 30.4 | 0.44 |
| V266_19Q | 89.2 | 34.7 | 0.39 |
| V266_20W | 71.9 | 9.0 | 0.13 |
| S267_01G | 104.6 | 53.8 | 0.51 |
| S267_02A | 243.3 | 150.4 | 0.62 |
| S267_03V | 192.3 | 30.8 | 0.16 |
| S267_04F | 48.0 | 11.0 | 0.23 |
| S267_05P | 31.5 | 15.7 | 0.50 |
| S267_06M | 209.5 | 66.0 | 0.31 |
| S267_07I | 192.4 | 25.2 | 0.13 |
| S267_08L | 108.7 | 19.5 | 0.18 |
| S267_09D | 310.5 | 180.8 | 0.58 |
| S267_10E | 379.3 | 91.9 | 0.24 |
| S267_14T | 104.4 | 45.6 | 0.44 |
| S267_15Y | 37.9 | 11.8 | 0.31 |
| S267_16H | 65.9 | 17.9 | 0.27 |
| S267_19Q | 217.5 | 65.0 | 0.30 |
| S267_20W | 57.2 | 21.5 | 0.37 |
| H268_01G | 143.6 | 96.7 | 0.67 |
| H268_02A | 166.6 | 122.2 | 0.73 |
| H268_05P | 116.1 | 76.4 | 0.66 |
| H268_13S | 159.6 | 121.9 | 0.76 |
| H268_18N | 156.3 | 104.1 | 0.67 |
| H268_20W | 111.4 | 82.8 | 0.74 |
| P271_01G | 193.3 | 113.2 | 0.59 |
| P271_08L | 102.7 | 71.0 | 0.69 |

TABLE 26-3

REGION d
IIIa/IIb = <0.8

| NAME | IIb binding He/Con_2b | IIIa binding He/Con_3a | IIIa/IIb He_3a/2b |
|---|---|---|---|
| P271_09D | 120.1 | 93.1 | 0.77 |
| P271_14T | 95.4 | 56.4 | 0.59 |
| Y296_01G | 79.3 | 54.5 | 0.69 |
| Y296_11K | 72.8 | 56.7 | 0.78 |
| Y296_13S | 86.3 | 61.8 | 0.72 |
| Y296_14T | 88.2 | 64.5 | 0.73 |
| Y296_16H | 92.2 | 73.4 | 0.80 |
| Y296_18N | 91.5 | 72.1 | 0.79 |
| S298_05P | 11.9 | 8.2 | 0.69 |
| S298_08L | 108.5 | 73.5 | 0.68 |
| Y300_05P | 7.3 | 2.8 | 0.38 |
| Y300_10E | 133.8 | 104.2 | 0.78 |
| K326_03V | 175.3 | 122.1 | 0.70 |
| K326_04F | 155.1 | 102.9 | 0.66 |
| K326_06M | 164.8 | 114.8 | 0.70 |
| K326_07I | 198.8 | 138.6 | 0.70 |
| K326_08L | 176.6 | 114.2 | 0.65 |
| K326_09D | 192.9 | 133.6 | 0.69 |
| K326_10E | 200.1 | 124.5 | 0.62 |
| K326_15Y | 159.4 | 112.3 | 0.70 |
| K326_19Q | 139.3 | 106.3 | 0.76 |
| K326_20W | 148.5 | 84.8 | 0.57 |
| A327_01G | 115.5 | 72.4 | 0.63 |
| N325_01G | 100.7 | 28.0 | 0.28 |
| N325_02A | 64.4 | 30.5 | 0.47 |
| N325_03V | 111.1 | 30.3 | 0.27 |
| N325_04F | 143.2 | 20.7 | 0.14 |
| N325_05P | 26.0 | 10.2 | 0.39 |
| N325_06M | 217.0 | 31.4 | 0.14 |
| N325_07I | 171.4 | 28.7 | 0.17 |
| N325_08L | 196.6 | 33.3 | 0.17 |
| N325_09D | 124.3 | 48.0 | 0.39 |
| N325_10E | 95.9 | 38.2 | 0.40 |
| N325_11K | 10.4 | 5.2 | 0.50 |
| N325_13S | 177.2 | 65.1 | 0.37 |
| N325_14T | 91.6 | 39.4 | 0.43 |
| N325_15Y | 99.5 | 29.5 | 0.30 |
| N325_19Q | 69.1 | 31.6 | 0.46 |
| N325_20W | 168.8 | 32.8 | 0.19 |
| S324_05P | 94.7 | 65.5 | 0.69 |
| A327_03V | 94.7 | 45.8 | 0.48 |
| A327_04F | 63.7 | 46.2 | 0.72 |
| A327_07I | 126.7 | 42.4 | 0.33 |
| A327_08L | 63.1 | 42.0 | 0.67 |
| A327_09D | 171.7 | 83.7 | 0.49 |
| A327_10E | 140.5 | 68.6 | 0.49 |
| A327_14T | 89.4 | 41.4 | 0.46 |
| A327_15Y | 60.8 | 46.8 | 0.77 |
| A327_16H | 63.5 | 43.7 | 0.69 |
| A327_18N | 113.1 | 61.1 | 0.54 |
| A327_20W | 78.8 | 51.2 | 0.65 |
| L328_01G | 80.2 | 44.9 | 0.56 |
| L328_02A | 144.5 | 79.1 | 0.55 |
| L328_03V | 125.7 | 78.7 | 0.63 |
| L328_04F | 218.8 | 79.3 | 0.36 |
| L328_05P | 65.1 | 40.5 | 0.62 |

TABLE 26-4

REGION d
IIIa/IIb = <0.8

| NAME | IIb binding He/Con_2b | IIIa binding He/Con_3a | IIIa/IIb He_3a/2b |
|---|---|---|---|
| L328_06M | 141.6 | 78.6 | 0.56 |
| L328_07I | 160.3 | 84.0 | 0.52 |
| L328_09D | 198.8 | 47.8 | 0.24 |
| L328_10E | 172.2 | 53.4 | 0.31 |
| L328_13S | 149.2 | 71.7 | 0.48 |
| L328_14T | 141.3 | 75.3 | 0.53 |

TABLE 26-4-continued

REGION d
IIIa/IIb = <0.8

| NAME | IIb binding He/Con_2b | IIIa binding He/Con_3a | IIIa/IIb He_3a/2b |
|---|---|---|---|
| L328_15Y | 192.9 | 68.3 | 0.35 |
| L328_16H | 80.6 | 54.3 | 0.67 |
| L328_18N | 80.8 | 49.7 | 0.61 |
| L328_19Q | 104.9 | 81.1 | 0.77 |
| L328_20W | 234.6 | 37.4 | 0.16 |
| P329_20W | 45.1 | 31.7 | 0.70 |
| P331_03V | 118.7 | 73.2 | 0.62 |
| P331_04F | 110.5 | 77.3 | 0.70 |
| P331_06M | 101.6 | 74.8 | 0.74 |
| P331_07I | 114.5 | 66.0 | 0.58 |
| P331_08L | 95.7 | 72.1 | 0.75 |
| P331_10E | 115.5 | 75.1 | 0.65 |
| P331_11K | 84.7 | 67.5 | 0.80 |
| P331_14T | 99.8 | 74.1 | 0.74 |
| P331_15Y | 114.4 | 81.9 | 0.72 |
| P331_16H | 116.0 | 80.2 | 0.69 |
| P331_18N | 99.2 | 73.4 | 0.74 |
| P331_20W | 111.2 | 78.6 | 0.71 |
| I332_11K | 70.9 | 45.1 | 0.64 |

The table shows a list of alterations that selectively enhance the binding to FcγRIIb as compared to FcγRIIIa.

[Example 9] Assessment of Heterodimerized Antibodies for Physicochemical Stability When antibodies are developed as pharmaceuticals, antibodies are expected to have high physicochemical stability. For example, as to an antibody alteration where the above-described S239D, A330L, and I332E are introduced into both antibody chains, it has been reported that the antibody Fc domain becomes thermodynamically unstable due to the introduced alteration (Molecular Immunology, 45, 1872-1882, 2008), and such reduced thermal stability makes it difficult to develop antibodies as pharmaceuticals. In order to increase the usefulness of antibodies as pharmaceuticals and to make the development simpler, it is also important to increase the FcγR-binding activity and maintain the physicochemical stability. In the case of homodimerized antibodies, alterations are introduced into both H chains, and this means that an antibody molecule introduced with a single type of alteration has the alteration at two sites. In the case of heterodimerized antibodies, on the other hand, it is possible to choose whether an alteration is introduced into either H chain, and thus, even when introducing a single type of alteration, it is introduced at only one site per an antibody molecule. As discussed in Example 7, depending on the type of alteration, as to the effect to increase the FcγRIIIa-binding activity, it is sometimes sufficient to introduce an alteration into one H chain. If an alteration has the effect to reduce the physicochemical stability of an antibody, one can confer the antibody with the effect to increase the FcγRIIIa-binding activity by introducing the alteration into only one H chain while minimizing the physicochemical destabilization of the antibody.

To assess this hypothesis, the present inventors assessed which residue of S239D, A330L, and I332E actually contributed to the destabilization of the CH2 domain. Expression vectors inserted with the following were prepared according to the method described in Reference Example 1: GpH7-B3-06-09D (SEQ ID NO: 37), GpH7-B3-20-08L (SEQ ID NO: 38), and GpH7-B3-22-10E (SEQ ID NO: 39) resulting from the introduction of the alterations S239D, A330L, and I332E, respectively, into GpH7-B3. Using GpL16-k0 as the L chain, antibodies of interest were expressed and prepared according to the method described in Reference Example 1. Furthermore, as a control, an antibody of interest was expressed and prepared using GpL16-k0 and GpH7-B3 which does not contain the alteration. The respective antibodies were compared for the Tm of the CH2 domain by thermal shift assay according to the method described in Reference Example 5 (Table 27). Hereinafter, unless otherwise specified, Tm means to the Tm of CH2 domain.

TABLE 27

| SAMPLE | H | MUTATION SITE | Tm (° C.) | ΔTm (° C.) |
|---|---|---|---|---|
| GpH7-B3/GpL16-k0 (SEQ ID NO: 4, 5) | B3 | — | 68 | 0 |
| GpH7-B3-06-09D/GpL16-k0 (SEQ ID NO: 37, 5) | B3-6-09D | S239D | 65 | −3 |
| GpH7-B3-20-08L/GpL16-k0 (SEQ ID NO: 38, 5) | B3-20-08L | A330L | 67 | −1 |
| GpH7-B3-22-10E/GpL16-k0 (SEQ ID NO: 39, 5) | B3-22-10E | I332E | 60 | −8 |

The column "SAMPLE" indicates antibody names; the column "H" indicates names of the H chain constant region of each antibody; the column "MUTATION SITE" indicates mutations that are different in comparison with GpH7-B3/GpL16-k0 ("-": when there is no particular mutation); the column "Tm" indicates the Tm of each antibody; and the column "ΔTm" indicates the difference in the Tm between each antibody and GpH7-B3/GpL16-k0. The SEQ ID NOs are also shown for the amino acid sequences of the H chain and L chain of each antibody.

When the homodimerized antibody GpH7-B3-06-09D/GpL16-k0 introduced with S239D, the homodimerized antibody GpH7-B3-20-08L/GpL16-k0 introduced with A330L, and the homodimerized antibody GpH7-B3-22-10E/GpL16-k0 introduced with I332E were compared to GpH7-B3/GpL16-k0, their Tm was decreased by 3° C., 1° C., and 8° C., respectively. This result demonstrates that, of the three alterations, I332E had the greatest effect to reduce the Tm of CH2, thus I332E is thought to also contribute to the decrease of Tm of an antibody introduced with the group of the alterations S239D, A330L, and I332E.

The side chain of I332E is surrounded by hydrophobic amino acids such as V240, V323, and L328. In an antibody introduced with I332E, the hydrophobic interaction with surrounding residues is abolished due to the substitution of hydrophobic Ile with hydrophilic Glu, and this is thought to contribute to the destabilization of the Fc domain. Meanwhile, as discussed in Example 7, the interaction of I332E with FcγRIIIa occurs exclusively in either H chain. For this reason, it was thought that when I332 is kept unsubstituted in the other H chain that is not involved in the interaction with FcγRIIIa, the thermodynamic stability can be maintained while conferring the effect to enhance the FcγRIIIa binding. Then, the present inventors introduced I332E into only one H chain, and assessed whether the Tm is elevated as compared to when I332E is introduced into both H chains. Expression vectors inserted with GpH7-A44 (SEQ ID NO: 49) and GpH7-B80 (SEQ ID NO: 50) resulting from the introduction of I332E into GpH7-A5 and GpH7-B3, respectively, were constructed. They were combined with GpH7-B3, GpH7-A5, and GpL16-k0 to express and prepare the following antibodies according to the method described in Reference Example 1: the heterodimerized antibodies GpH7-A5/GpH7-B80/GpL16-k0 and GpH7-A44/GpH7-B3/GpL16-k0 in which only one of the H chains was introduced with I332E, and the homodimerized antibody GpH7-A44/GpH7-B80/GpL16-k0 in which both of the H chains were introduced with I332E. GpH7-A5/GpH7-B3/GpL16-k0 was prepared as a control. Each antibody was assessed for the FcγRIIIa-binding activity according to the method described in Reference Example 2. In addition, the antibodies were compared for the Tm of CH2 domain by thermal shift assay according to the method described in Reference Example 5 (Tables 28 and 29).

by about 4 times that of GpH7-A5/GpH7-B3/GpL16-k0. From this, it was thought that the effect of I332E to increase the FcγRIIIa-binding activity is not significantly altered regardless of when I332E is introduced into GpH7-A5 or it is introduced into GpH7-B3. Meanwhile, the FcγRIIIa-binding activity of GpH7-A44/GpH7-B80/GpL16-k0 in which both of the H chains were introduced with I332E was increased by about 7 times that of GpH7-A5/GpH7-B3/GpL16-k0. These findings revealed that I332E has an effect to sufficiently increase the FcγRIIIa-binding activity even if

TABLE 28

| SAMPLE | H1 | MUTATION SITE | H2 | MUTATION SITE | KD (M) | KD ratio |
|---|---|---|---|---|---|---|
| GpH7-A5/GpH7-B3/GpL16-k0 (SEQ ID NO: 3, 4, 5) | A5 | — | B3 | — | 1.6E−06 | 1.0 |
| GpH7-A5/GpH7-B80/GpL16-k0 (SEQ ID NO: 3, 50, 5) | A5 | — | B80 | I332E | 4.7E−07 | 3.4 |
| GpH7-A44/GpH7-B3/GpL16-k0 (SEQ ID NO: 49, 4, 5) | A44 | I332E | B3 | — | 3.7E−07 | 4.4 |
| GpH7-A44/GpH7-B80/GpL16-k0 (SEQ ID NO: 49, 50, 5) | A44 | I332E | B80 | I332E | 2.3E−07 | 7.1 |

The column "SAMPLE" indicates antibody names; the columns "H1" and "H2" indicate names of the H chain constant region of each antibody; and the column "MUTATION SITE" indicates mutations that are different in comparison with GpH7-A5/GpH7-B3/GpL16-k0 ("-": when there is no particular mutation). A value obtained by dividing KD of GpH7-A5/GpH7-B3/GpL16-k0 for FcγRIIIa by the KD of each antibody was defined as "KD ratio". The SEQ ID NOs are also shown for the amino acid sequences of the H chain and L chain of each antibody.

introduced into only one H chain, if not introduced into both H chains, as considered based on the three-dimensional structure.

Furthermore, the result shown in Table 29 revealed that the Tm of the heterodimerized antibodies GpH7-A5/GpH7-B80/GpL16-k0 and GpH7-A44/GpH7-B3/GpL16-k0 in which I332E was introduced into only one H chain, were both decreased by 4° C. compared to the Tm of GpH7-A5/GpH7-B3/GpL16-k0 which is their parental Fc molecule. Thus, it was thought that there is no difference in the

TABLE 29

| SAMPLE | H1 | MUTATION SITE | H2 | MUTATION SITE | Tm (° C.) | ΔTm (° C.) |
|---|---|---|---|---|---|---|
| GpH7-A5/GpH7-B3/GpL16-k0 (SEQ ID NO: 3, 4, 5) | A5 | — | B3 | — | 68 | 0 |
| GpH7-A5/GpH7-B80/GpL16-k0 (SEQ ID NO: 3, 50, 5) | A5 | — | B80 | I332E | 64 | −4 |
| GpH7-A44/GpH7-B3/GpL16-k0 (SEQ ID NO: 49, 4, 5) | A44 | I332E | B3 | — | 64 | −4 |
| GpH7-A44/GpH7-B80/GpL16-k0 (SEQ ID NO: 49, 50, 5) | A44 | I332E | B80 | I332E | 58 | −10 |

The table shows the Tm of CH2 of antibodies with I332E substitution in one H chain, and antibodies with I332E substitution in both H chains.

The column "SAMPLE" indicates antibody names; the columns "H1" and "H2" indicate names of the H chain constant region of each antibody; the column "MUTATION SITE" indicates mutations that are different in comparison with GpH7-A5/GpH7-B3/GpL16-k0 ("-": when there is no particular mutation); the column "Tm" indicates the Tm of each antibody; and the column "ΔTm" indicates the difference in the Tm between each antibody and GpH7-B3/GpL16-k0. The SEQ ID NOs are also shown for the amino acid sequences of the H chain and L chain of each antibody.

The result shown in Table 28 demonstrates that the FcγRIIIa-binding activity of the heterodimerized antibody GpH7-A5/GpH7-B80/GpL16-k0 in which only one of the H chains was introduced with I332E was increased by about 3 times that of GpH7-A5/GpH7-B3/GpL16-k0, while the activity of GpH7-A44/GpH7-B3/GpL16-k0 was increased influence of I332E on antibody Tm regardless of when I332E is introduced into GpH7-A5 or GpH7-B3. Meanwhile, the Tm of the homodimerized antibody GpH7-A44/GpH7-B80/GpL16-k0 in which both of the H chains were introduced with I332E was decreased by 10° C. compared to that of GpH7-A5/GpH7-B3/GpL16-k0. The Tm of the heterodimerized antibody in which only one of the H chains was introduced with I332E was maintained to be 6° C. higher than that of the homodimerized antibody in which both of the H chains were introduced with I332E. This result demonstrates that the decrease in the Tm can be suppressed by using a heterodimerized antibody in which only one, not both, of the H chains is introduced with I332E. This shows that the heterodimerized antibody technology is useful to maintain the antibody physicochemical stability.

The alteration I332E is superior in terms of the effect to enhance the FcγRIIIa binding; however, if conventional homodimerized antibodies are used with it, their thermodynamic stability is significantly reduced, and this is problematic when antibodies are used as pharmaceuticals. However, the results shown in Tables 28 and 29 demonstrate that the use of a heterodimerized antibody enables exploiting the effect of I332E to enhance the FcγRIIIa while maintaining the physicochemical antibody stability. From this finding, it is thought that heterodimerized antibodies are an excellent technology for more finely adjusting the FcγR-binding activity and the physicochemical stability of antibodies.

GpH7-TA7/GpH7-B78/GpL16-k0 has S239D, A330L, and I332E in only one H chain, and thus possibly retains high Tm as compared to GpH7-A57/GpH7-B78/GpL16-k0 in which both of the H chains have S239D, A330L, and I332E. Thus, the heterodimerized and homodimerized antibodies resulting from the combination of the group of the alterations L234Y, G236W, and S298A with the group of the alterations S239D, A330L, and I332E described in Example 7 were assayed for Tm according to the method described in Reference Example 5.

To assess this, the heterodimerized antibody GpH7-TA7/GpH7-B78/GpL16-k0 in which one of the H chains was introduced with the group of the alterations L234Y, G236W, and S298A and the other H chain was introduced with the group of the alterations S239D, A330L, and I332E; the heterodimerized antibody GpH7-TA7/GpH7-B3/GpL16-k0 in which only one of the H chains was introduced with the group of the alterations L234Y, G236W, and S298A; the homodimerized antibody GpH7-TA7/GpH7-TA45/GpL16-k0 in which both of the H chains were introduced with the group of the alterations L234Y, G236W, and S298A; the heterodimerized antibody GpH7-A5/GpH7-B78/GpL16-k0 in which only one of the H chains was introduced with S239D, A330L, and I332E, and the homodimerized antibody GpH7-A57/GpH7-B78/GpL16-k0 in which both of the H chains were introduced with S239D, A330L, and I332E, were prepared according to the method described in Reference Example 1. The influence of the combination of L234Y, G236W, and S298A with S239D, A330L, and I332E on the Tm was assessed by comparing the Tm of CH2 domain of the respective antibodies by thermal shift assay according to the method described in Reference Example 5 (Table 30).

GpL16-k0. The SEQ ID NOs are also shown for the amino acid sequences of the H chain and L chain of each antibody.

GpH7-A5/GpH7-B3/GpL16-k0 introduced with alterations D356K/H435R and K439E to increase the efficiency of heterodimerized antibody formation was compared to GpH7-G1d/GpL16-k0 which is a native IgG1. The Tm of CH2 was decreased by 1° C.

Homodimerized antibodies of the prior-art technology were assessed for the effect of each alteration group. The Tm of the homodimerized antibody GpH7-A57/GpH7-B78/GpL16-k0 in which both of the H chains were introduced with S239D, A330L, and I332E was decreased by 20° C. as compared to GpH7-A5/GpH7-B3/GpL16-k0. Meanwhile, a decrease in the Tm was not observed for the homodimerized antibody GpH7-TA7/GpH7-TA45/GpL16-k0 in which both of the H chains were introduced with the group of the alterations L234Y, G236W, and S298A. Thus, it was thought that the group of the alterations L234Y, G236W, and S298A does not have the effect to decrease the Tm of homodimerized antibodies.

Heterodimerized antibodies in which only one of the H chains was introduced with each alteration group were assessed for the effect of each alteration group. The Tm of the heterodimerized antibody GpH7-A5/GpH7-B78/GpL16-k0 in which one of the H chains was introduced with S239D, A330L, and I332E was decreased by 8° C. as compared to GpH7-A5/GpH7-B3/GpL16-k0. Meanwhile, a decrease in Tm was not observed for the heterodimerized antibody GpH7-TA7/GpH7-B3/GpL16-k0 in which one of the H chains was introduced with L234Y, G236W, and S298A. From these findings, it was thought that the group of the alterations L234Y, G236W, and S298A does not have the effect to decrease the Tm of heterodimerized antibodies either.

The Tm of GpH7-A57/GpH7-B78/GpL16-k0 in which both of the H chains were introduced with S239D, A330L, and I332E was decreased by 21° C. as compared to the native IgG1. The Tm of GpH7-A5/GpH7-B78/GpL16-k0 in which only one of the H chains has the alterations S239D, A330L, and I332E was 60° C., and it retained Tm 10° C. or

TABLE 30

| Sample | H1 | MUTATION SITE | H2 | MUTATION SITE | Tm (° C.) | ΔTm (° C.) |
|---|---|---|---|---|---|---|
| GpH7-G1d/GpL16-k0 (SEQ ID NO: 2, 5) | G1d | — | G1d | — | — | 69 | 1 |
| GpH7-A5/GpH7-B3/GpL16-k0 (SEQ ID NO: 3, 4, 5) | A5 | D356K/H435R | — | B3 | K439E | — | 68 | 0 |
| GpH7-TA7/GpH7-B3/GpL16-k0 (SEQ ID NO: 31, 4, 5) | TA7 | D356K/H435R | L234Y/G236W/S298A | B3 | K439E | — | 68 | 0 |
| GpH7-A5/GpH7-B78/GpL16-k0 (SEQ ID NO: 3, 41, 5) | A5 | D356K/H435R | — | B78 | K439E | S239D/A330L/I332E | 60 | −8 |
| GpH7-A57/GpH7-B78/GpL16-k0 (SEQ ID NO: 40, 41, 5) | A57 | D356K/H435R | S239D/A330L/I332E | B78 | K439E | S239D/A330L/I332E | 48 | −20 |
| GpH7-TA7/GpH7-TA45/GpL16-k0 (SEQ ID NO: 31, 32, 5) | TA7 | D356K/H435R | L234Y/G236W/S298A | TA45 | K439E | L234Y/G236W/S298A | 68 | 0 |
| GpH7-TA7/GpH7-B78/GpL16-k0 (SEQ ID NO: 31, 41, 5) | TA7 | D356K/H435R | L234Y/G236W/S298A | B78 | K439E | S239D/A330L/I332E | 59 | −9 |

The column "Sample" indicates antibody names; the columns "H1" and "H2" indicate names of the H chain constant region of each antibody; the column "MUTATION SITE" indicates mutations that are different in comparison with GpH7-G1d/GpL16-k0 ("-": when there is no particular mutation); the column "Tm" indicates the Tm of each antibody; and the column "ΔTm" indicates the difference in the Tm between each antibody and GpH7-A5/GpH7-B3/ more higher than that of the homodimerized antibody. As shown in Table 13 of Example 7, the FcγRIIIa binding of the homodimerized antibody with S239D, A330L, and I332E was increased by about 9 times that of the heterodimerized antibody with S239D, A330L, and I332E. S239D, A330L, and I332E, when introduced into both H chains, strongly enhance the FcγRIIIa binding, but significantly reduce the Tm.

Furthermore, the Tm of GpH7-TA7/GpH7-TA45/GpL16-k0 in which both of the H chains were introduced with L234Y, G236W, and S298A was only decreased by 1° C. as compared to the native antibody. The decrease of Tm was thought to be due to the influence of D356K/H435R and K439E used to construct the heterodimerized antibody as discussed above, rather than due to L234Y, G236W, and S298A. This is also shown by the fact that the Tm of GpH7-TA7/GpH7-B3/GpL16-k0 in which one of the H chains was introduced with L234Y, G236W, and S298A was also only decreased by 1° C.

Finally, the Tm of GpH7-TA7/GpH7-B78/GpL16-k0 in which one of the H chains has L234Y, G236W, and S298A and the other H chain has S239D, A330L, and I332E was decreased by 10° C. compared to the native antibody, and was almost equivalent to that of GpH7-A5/GpH7-B78/GpL16-k0 in which one of the H chains was introduced with S239D, A330L, and I332E. However, as shown in Table 13 of Example 7, the FcγRIIIa binding of GpH7-TA7/GpH7-B78/GpL16-k0 is enhanced by 10 times or more compared to that of GpH7-A5/GpH7-B78/GpL16-k0.

That is, it was demonstrated that, by using the heterodimerized antibody GpH7-TA7/GpH7-B78/GpL16-k0 in which one of the H chains was introduced with L234Y, G236W, and S298A and the other was introduced with S239D, A330L, and I332E, the FcγRIIIa binding can be enhanced, and also, the Tm can be increased by 10° C. or more, as compared to the homodimerized antibody GpH7-A57/GpH7-B78/GpL16-k0 with S239D, A330L, and I332E.

Then, the above described samples subjected to Tm measurement were further assessed for the thermodynamic stability by the heat accelerated stability study described in Reference Example 6 (at 40° C. for two or four weeks) (FIG. 30).

When GpH7-A5/GpH7-B3/GpL16-k0 was compared to the native antibody GpH7-G1d/GpH7-G1d/GpL16-k0, the monomer contents of the former and latter were decreased by 1.27% and 1.86% after four weeks, respectively, and there was no significant difference. Thus, it was thought that the alterations D356K/H435R and K439E used to construct the heterodimerized antibody have almost no influence on the change in the monomer content in heat accelerated stability study.

Regarding GpH7-A57/GpH7-B78/GpL16-k0 in which both of the H chains were introduced with S239D, A330L, and I332E, the monomer content was decreased by about 16% after four weeks. Meanwhile, the monomer content of GpH7-A5/GpH7-B78/GpL16-k0 in which only one of the H chains has the alterations S239D, A330L, and I332E was decreased by 9.63% after four weeks. Thus, it was demonstrated that the effect of more stably maintaining the monomer content was achieved by using heterodimerized antibodies in which only one of the H chains was introduced with S239D, A330L, and I332E.

Furthermore, the monomer content of GpH7-TA7/GpH7-TA45/GpL16-k0 in which both of the H chains were introduced with L234Y, G236W, and S298A and GpH7-TA7/GpH7-B3/GpL16-k0 in which one of the H chains was introduced with L234Y, G236W, and S298A was only decreased by 1.78% and 1.42% after four weeks, respectively. There was no clear difference in the monomer content change as compared to the native antibody. Thus, it was thought that L234Y, G236W, and S298A do not affect the monomer content in heat accelerated stability study even when they are introduced into one H chain or both H chains.

Finally, the monomer content of GpH7-TA7/GpH7-B78/GpL16-k0 in which one of the H chains has L234Y, G236W, and S298A and the other H chain has S239D, A330L, and I332E was decreased by 2.47% after four weeks. The monomer content was only slightly reduced compared to 1.86% for the native antibody. Thus, it was demonstrated that, by using the heterodimerized antibody GpH7-TA7/GpH7-B78/GpL16-k0 in which one of the H chains has L234Y, G236W, and S298A and the other H chain has S239D, A330L, and I332E, the FcγRIIIa binding can be enhanced, and also, the effect of retaining the monomer content at a high level in heat accelerated stability study can be achieved as compared to the homodimerized antibody GpH7-A57/GpH7-B78/GpL16-k0 with S239D, A330L, and I332E.

Thus, it was demonstrated that, when compared to conventional homodimerized antibodies, the technology of heterodimerized antibodies is not only capable of enhancing the FcγR binding but also improves the stability, and thereby increases the value of antibodies as pharmaceuticals more than homodimerized antibodies.

[Example 10] Search for Alterations that Improve FcγR Binding but do not Reduce the Stability As described in Example 9, the FcγR-binding activity is increased by introducing alterations in the H chain. However, such alterations can reduce the physicochemical stability of CH2, i.e., reduce the Tm. However, as described in Example 9, such properties are unfavorable, in particular when antibodies are used as pharmaceuticals. As described in Example 9, it is useful to use the heterodimerized antibody in which only one of the H chains has been introduced with alterations to enhance the FcγR-binding activity while suppressing the destabilization of CH2. Specifically, with respect to alterations that decrease the Tm of homodimerized antibodies even though they are observed to enhance the FcγR-binding activity of conventional homodimerized antibodies, such as those corresponding to Regions ii and iii shown in FIG. 21, their heterodimerization allows the Tm to be higher than that of the homodimerized antibodies while increasing the FcγR-binding activity as compared to the native antibody.

To find such alterations, homodimerized antibodies in Regions ii and iii shown in FIG. 21 were assayed for Tm according to the method described in Reference Example 5. A list of alterations that reduce the Tm as compared to the native antibody is shown in Tables 31 to 35.

Table 31 (Tables 31-1 to 31-3) shows data for Ia where Tm is 68° C. or less for Region ii or iii; Table 32 (Tables 32-1 and 32-2) shows data for IIaR where Tm is 68° C. or less for Region ii or iii; Table 33 (Tables 33-1 and 33-2) shows data for IIaH where Tm is 68° C. or less for Region ii or iii; Table 34 (Tables 34-1 and 34-2) shows data for IIb where Tm is 68° C. or less for Region ii or iii; Table 35 (Tables 35-1 and 35-2) shows data for IIIa where Tm is 68° C. or less for Region ii or iii.

Antibodies that have improved FcγR binding as compared to the native antibody and whose stability is not significantly reduced can be produced by using a heterodimerized antibody in which only one of the H chains is introduced with these alterations.

TABLE 31-1

| NAME | Tm | Ho/Con_1a | He/Con_1a |
|---|---|---|---|
| A327_09D | 65.68 | 101.6 | 102.8 |
| A330_08L | 66.88 | 106.1 | 106.9 |

TABLE 31-1-continued

| NAME | Tm | Ho/Con_1a | He/Con_1a |
|---|---|---|---|
| A330_09D | 65.88 | 108.0 | 108.6 |
| A330_14T | 67.88 | 104.8 | 105.1 |
| E269_04F | 67 | 102.4 | 103.1 |
| E269_06M | 68 | 101.3 | 103.6 |
| E269_08L | 67.72 | 101.1 | 103.6 |
| E269_15Y | 67.92 | 100.2 | 106.4 |
| E333_01G | 61.48 | 100.4 | 102.7 |
| E333_13S | 65.88 | 100.6 | 103.1 |
| G236_20W | 64.8 | 104.4 | 105.2 |
| I336_01G | 53.28 | 104.3 | 108.7 |
| I336_02A | 61.8 | 103.1 | 106.0 |
| I336_03V | 67.2 | 104.8 | 105.2 |
| I336_04F | 56.28 | 103.9 | 105.5 |
| I336_06M | 61.68 | 104.0 | 108.2 |
| I336_10E | 53.8 | 107.2 | 107.8 |
| I336_18N | 62 | 103.6 | 107.8 |
| K326_14T | 64.08 | 102.9 | 104.1 |
| K326_15Y | 65.72 | 101.2 | 105.9 |
| K326_16H | 66.68 | 100.9 | 103.4 |
| K334_10E | 63.6 | 106.9 | 109.8 |
| P271_02A | 67 | 102.5 | 103.5 |
| P271_03V | 66.2 | 102.0 | 102.3 |
| P271_04F | 66.68 | 100.3 | 101.8 |
| P271_06M | 66.68 | 102.0 | 102.5 |
| P271_07I | 66.12 | 101.9 | 102.5 |
| P271_11K | 65.2 | 101.1 | 102.8 |
| P271_12R | 65.12 | 101.2 | 102.4 |
| P271_13S | 67.12 | 100.7 | 102.4 |
| P271_20W | 67.32 | 101.5 | 102.6 |
| Q295_02A | 66.52 | 104.1 | 104.3 |
| Q295_03V | 67.8 | 101.6 | 104.1 |
| Q295_04F | 67.8 | 100.3 | 102.2 |
| Q295_05P | 64.32 | 101.1 | 103.4 |
| Q295_07I | 66.48 | 101.2 | 103.0 |
| Q295_13S | 65.52 | 101.4 | 102.0 |
| Q295_14T | 65.92 | 102.5 | 102.7 |
| Q295_18N | 65.88 | 100.8 | 102.4 |
| S239_01G | 64.92 | 100.7 | 101.3 |
| S239_09D | 65 | 100.8 | 101.0 |
| S267_01G | 67.2 | 102.2 | 103.2 |
| S267_02A | 66.72 | 108.5 | 108.9 |
| S267_03V | 66 | 102.4 | 106.0 |
| S267_09D | 65.4 | 105.8 | 109.7 |
| S298_03V | 65 | 106.2 | 109.7 |
| S298_07I | 64.32 | 103.3 | 107.0 |
| S298_08L | 65.52 | 104.2 | 106.7 |
| S298_10E | 67 | 106.1 | 108.2 |
| S298_14T | 66.08 | 106.5 | 107.1 |
| S298_15Y | 65.68 | 103.1 | 107.2 |
| S298_16H | 65.12 | 106.8 | 108.8 |
| S298_18N | 67.2 | 103.9 | 108.1 |
| S298_19Q | 66.52 | 104.7 | 109.4 |
| S324_02A | 66.32 | 102.6 | 102.7 |
| S324_03V | 66.28 | 103.0 | 103.6 |
| S324_08L | 67.4 | 102.7 | 103.2 |
| S324_14T | 67.12 | 112.4 | 120.9 |
| S324_19Q | 67.2 | 110.7 | 112.3 |
| S324_20W | 58.2 | 111.5 | 114.3 |
| S337_01G | 64.92 | 102.3 | 106.6 |
| S337_02A | 67 | 103.1 | 105.8 |
| S337_03V | 65.32 | 105.1 | 106.7 |

TABLE 31-2

| NAME | Tm | Ho/Con_1a | He/Con_1a |
|---|---|---|---|
| S337_04F | 65.88 | 104.7 | 106.2 |
| S337_06M | 66.4 | 102.1 | 106.9 |
| S337_07I | 63.32 | 105.3 | 105.3 |
| S337_08L | 62.6 | 105.3 | 105.3 |
| S337_09D | 56.52 | 105.5 | 105.7 |
| S337_10E | 62.08 | 104.2 | 106.4 |
| S337_15Y | 65.48 | 103.6 | 103.8 |
| S337_19Q | 66.88 | 104.6 | 104.6 |
| S337_20W | 64.4 | 104.3 | 104.9 |

TABLE 31-2-continued

| NAME | Tm | Ho/Con_1a | He/Con_1a |
|---|---|---|---|
| T335_04F | 64.6 | 104.8 | 105.0 |
| T335_05P | 57.12 | 106.2 | 106.4 |
| T335_06M | 66.2 | 106.0 | 106.7 |
| T335_07I | 67 | 105.1 | 109.1 |
| T335_08L | 64.88 | 105.4 | 114.6 |
| T335_09D | 61.2 | 106.8 | 107.5 |
| T335_10E | 62.92 | 107.8 | 108.8 |
| T335_11K | 67 | 102.8 | 110.8 |
| T335_12R | 67 | 106.0 | 112.8 |
| T335_15Y | 64.72 | 106.3 | 107.2 |
| T335_16H | 64.28 | 104.5 | 105.7 |
| T335_18N | 63.8 | 102.2 | 105.8 |
| T335_19Q | 64.92 | 104.6 | 105.0 |
| T335_20W | 65 | 104.2 | 106.2 |
| Y296_06M | 65.68 | 103.8 | 104.0 |
| Y296_11K | 67 | 102.0 | 104.7 |
| Y296_12R | 67.32 | 102.9 | 106.3 |
| Y296_16H | 67.32 | 105.3 | 105.8 |
| Y296_20W | 66.72 | 106.2 | 110.8 |
| Y300_02A | 66.2 | 109.8 | 112.2 |
| Y300_03V | 63.6 | 112.4 | 117.0 |
| Y300_06M | 61.92 | 111.0 | 112.2 |
| Y300_08L | 60.6 | 109.3 | 113.1 |
| Y300_11K | 66 | 101.2 | 106.9 |
| Y300_13S | 64.52 | 110.3 | 111.1 |
| Y300_14T | 63.72 | 109.6 | 111.7 |
| Y300_19Q | 63 | 110.1 | 112.5 |
| Y300_20W | 67.52 | 110.5 | 112.4 |
| A330_01G | 67.0 | 106.4 | 105.7 |
| A330_04F | 67.3 | 106.9 | 106.1 |
| A330_10E | 67.2 | 108.1 | 107.4 |
| A330_19Q | 67.4 | 105.9 | 105.2 |
| A330_20W | 67.9 | 108.2 | 107.6 |
| D265_10E | 61.4 | 103.4 | 101.4 |
| H268_01G | 67.5 | 108.0 | 107.2 |
| H268_09D | 67.1 | 110.5 | 109.5 |
| H268_10E | 67.6 | 111.6 | 111.0 |
| H268_13S | 67.8 | 109.7 | 109.3 |
| H268_18N | 66.8 | 108.4 | 107.9 |
| I336_07I | 67.9 | 106.1 | 104.4 |
| I336_08L | 64.8 | 109.4 | 107.4 |
| I336_09D | 53.5 | 107.7 | 103.6 |
| I336_11K | 54.7 | 106.8 | 105.4 |
| I336_12R | 55.7 | 108.7 | 102.0 |
| I336_13S | 57.4 | 109.5 | 102.5 |
| I336_14T | 64.1 | 111.2 | 104.5 |

TABLE 31-3

| NAME | Tm | Ho/Con_1a | He/Con_1a |
|---|---|---|---|
| I336_15Y | 57.9 | 109.7 | 102.9 |
| I336_16H | 53.4 | 114.0 | 101.4 |
| K326_03V | 66.5 | 103.3 | 101.8 |
| K326_04F | 65.3 | 102.3 | 101.9 |
| K326_06M | 66.6 | 103.7 | 102.5 |
| K326_07I | 66.1 | 101.6 | 100.6 |
| K326_08L | 67.1 | 101.0 | 100.2 |
| K326_09D | 68.0 | 105.5 | 103.4 |
| K326_10E | 68.0 | 105.4 | 103.8 |
| K326_19Q | 67.9 | 104.6 | 102.3 |
| K326_20W | 65.5 | 104.4 | 103.2 |
| K334_01G | 64.2 | 105.6 | 103.5 |
| K334_02A | 65.8 | 106.0 | 105.9 |
| K334_03V | 67.0 | 105.3 | 104.7 |
| K334_04F | 65.9 | 106.1 | 105.3 |
| K334_05P | 62.0 | 106.2 | 104.3 |
| K334_07I | 67.3 | 106.8 | 104.3 |
| K334_08L | 66.2 | 107.6 | 104.7 |
| K334_09D | 65.6 | 107.6 | 106.5 |
| K334_13S | 66.1 | 105.8 | 104.9 |
| K334_14T | 65.7 | 105.5 | 104.8 |
| K334_15Y | 65.9 | 106.6 | 104.7 |
| K334_16H | 62.8 | 105.9 | 104.9 |
| K334_18N | 65.4 | 107.6 | 104.6 |

TABLE 31-3-continued

| NAME | Tm | Ho/Con_1a | He/Con_1a |
|---|---|---|---|
| K334_19Q | 67.1 | 106.1 | 106.1 |
| L328_15Y | 65.5 | 104.5 | 101.6 |
| P271_01G | 68.0 | 105.5 | 104.8 |
| P271_08L | 66.4 | 103.4 | 102.2 |
| P271_10E | 67.9 | 103.3 | 102.8 |
| P271_18N | 66.2 | 103.4 | 103.2 |
| P271_19Q | 66.5 | 103.6 | 103.1 |
| Q295_10E | 64.9 | 104.7 | 103.1 |
| Q295_12R | 63.9 | 101.4 | 100.4 |
| S239_10E | 66.0 | 105.5 | 105.2 |
| S267_06M | 66.4 | 106.4 | 105.9 |
| S267_10E | 64.1 | 106.9 | 105.8 |
| S267_14T | 67.8 | 107.4 | 101.5 |
| S267_18N | 66.6 | 106.9 | 102.4 |
| S267_19Q | 66.8 | 103.6 | 102.5 |
| S298_09D | 67.4 | 106.5 | 105.9 |
| S324_09D | 66.2 | 105.5 | 103.5 |
| S324_10E | 66.9 | 106.3 | 104.9 |
| S337_11K | 67.3 | 104.7 | 104.0 |
| S337_14T | 67.3 | 106.3 | 105.1 |
| S337_16H | 66.6 | 104.8 | 104.7 |
| S337_18N | 64.1 | 106.2 | 105.3 |
| T335_01G | 63.2 | 105.8 | 104.4 |
| T335_02A | 65.8 | 105.2 | 103.3 |
| T335_13S | 67.6 | 105.1 | 104.8 |
| T335_14T | 68.0 | 107.0 | 106.5 |
| Y296_02A | 67.0 | 103.4 | 102.9 |
| Y296_03V | 66.7 | 104.4 | 104.0 |
| Y296_07I | 65.9 | 105.9 | 104.3 |
| Y296_08L | 66.9 | 104.9 | 103.9 |
| Y300_07I | 60.5 | 109.1 | 107.8 |
| Y300_16H | 63.7 | 111.1 | 110.9 |

TABLE 32-1

| NAME | Tm | Ho/Con_2aR | He/Con_2aR |
|---|---|---|---|
| A327_09D | 65.7 | 120.0 | 123.8 |
| A327_10E | 65.4 | 103.7 | 110.2 |
| A330_01G | 67.0 | 105.9 | 108.9 |
| A330_12R | 67.9 | 100.8 | 103.5 |
| G237_04F | 66.8 | 112.8 | 126.2 |
| G237_20W | 67.6 | 107.1 | 138.3 |
| H268_01G | 67.5 | 122.0 | 124.2 |
| I332_06M | 65.0 | 105.4 | 108.8 |
| I336_07I | 67.9 | 105.8 | 108.3 |
| I336_08L | 64.8 | 105.4 | 110.2 |
| K326_03V | 66.5 | 138.9 | 140.7 |
| K326_04F | 65.3 | 132.7 | 135.1 |
| K326_07I | 66.1 | 133.2 | 147.0 |
| K326_08L | 67.1 | 130.7 | 136.8 |
| K326_15Y | 65.7 | 133.8 | 136.4 |
| K326_20W | 65.5 | 119.9 | 130.8 |
| K334_02A | 65.8 | 100.1 | 104.9 |
| K334_04F | 65.9 | 109.5 | 110.4 |
| K334_05P | 62.0 | 101.5 | 103.1 |
| K334_08L | 66.2 | 105.1 | 106.2 |
| K334_10E | 63.6 | 105.7 | 105.7 |
| K334_13S | 66.1 | 105.6 | 109.1 |
| K334_19Q | 67.1 | 108.1 | 109.1 |
| L235_20W | 67.9 | 114.4 | 130.9 |
| L328_13S | 64.5 | 107.9 | 116.6 |
| L328_14T | 64.9 | 118.2 | 118.9 |
| P238_03V | 66.8 | 115.8 | 120.4 |
| P238_04F | 66.4 | 146.3 | 174.4 |
| P271_08L | 66.4 | 102.5 | 103.8 |
| P331_02A | 66.0 | 102.2 | 106.0 |
| P331_04F | 63.0 | 106.3 | 110.6 |
| P331_15Y | 63.2 | 105.2 | 112.4 |
| P331_16H | 63.0 | 100.2 | 114.0 |
| P331_20W | 61.8 | 101.9 | 109.8 |
| S239_08L | 67.6 | 105.6 | 121.5 |
| S239_10E | 66.0 | 121.7 | 134.9 |
| S239_18N | 67.5 | 103.0 | 110.7 |
| S267_03V | 66.0 | 114.7 | 116.5 |
| S267_06M | 66.4 | 102.3 | 122.5 |
| S267_09D | 65.4 | 167.1 | 173.0 |
| S267_19Q | 66.8 | 110.3 | 135.2 |
| S298_08L | 65.5 | 101.4 | 104.9 |
| S324_06M | 66.1 | 117.9 | 123.1 |
| S337_02A | 67.0 | 101.5 | 105.0 |
| S337_03V | 65.3 | 102.0 | 106.1 |
| S337_06M | 66.4 | 100.9 | 105.2 |
| S337_07I | 63.3 | 102.8 | 108.9 |
| S337_09D | 56.5 | 113.5 | 114.8 |
| S337_10E | 62.1 | 110.0 | 111.6 |
| S337_15Y | 65.5 | 100.4 | 105.4 |
| S337_16H | 66.6 | 106.6 | 108.6 |
| S337_18N | 64.1 | 103.1 | 106.6 |
| S337_19Q | 66.9 | 101.8 | 105.6 |
| S337_20W | 64.4 | 104.7 | 110.5 |
| T335_02A | 65.8 | 102.3 | 102.4 |
| T335_05P | 57.1 | 103.6 | 103.6 |
| T335_07I | 67.0 | 106.7 | 109.2 |
| T335_10E | 62.9 | 108.7 | 111.3 |
| T335_13S | 67.6 | 101.6 | 109.6 |
| T335_14T | 68.0 | 106.0 | 109.8 |

TABLE 32-2

| NAME | Tm | Ho/Con_2aR | He/Con_2aR |
|---|---|---|---|
| T335_15Y | 64.7 | 107.1 | 111.4 |
| T335_16H | 64.3 | 102.5 | 108.2 |
| T335_18N | 63.8 | 100.4 | 106.3 |
| T335_19Q | 64.9 | 102.1 | 106.0 |
| T335_20W | 65.0 | 101.2 | 108.7 |
| V266_06M | 64.8 | 145.6 | 149.9 |
| Y296_20W | 66.7 | 106.9 | 109.8 |
| G236_09D | 66.2 | 107.1 | 106.1 |
| G236_10E | 65.9 | 139.8 | 124.9 |
| H268_09D | 67.1 | 157.2 | 149.3 |
| H268_10E | 67.6 | 153.6 | 147.7 |
| H268_13S | 67.8 | 135.2 | 127.3 |
| H268_18N | 66.8 | 134.4 | 128.4 |
| I332_04F | 61.9 | 108.6 | 105.0 |
| I332_09D | 56.2 | 126.8 | 118.9 |
| I332_10E | 60.1 | 123.3 | 114.1 |
| I332_15Y | 59.4 | 111.1 | 109.6 |
| K326_06M | 66.6 | 142.9 | 137.9 |
| K326_09D | 68.0 | 158.1 | 148.0 |
| K326_10E | 68.0 | 155.5 | 147.8 |
| K326_14T | 64.1 | 140.8 | 134.0 |
| K326_16H | 66.7 | 122.7 | 120.0 |
| K326_19Q | 67.9 | 137.4 | 129.2 |
| K334_03V | 67.0 | 123.3 | 117.2 |
| K334_07I | 67.3 | 120.9 | 113.8 |
| K334_14T | 65.7 | 117.2 | 111.9 |
| K334_15Y | 65.9 | 112.5 | 108.4 |
| K334_16H | 62.8 | 110.7 | 109.4 |
| K334_18N | 65.4 | 113.0 | 111.7 |
| L328_03V | 64.9 | 116.3 | 116.2 |
| L328_04F | 67.2 | 144.8 | 137.9 |
| L328_06M | 67.7 | 124.2 | 115.4 |
| L328_07I | 66.0 | 140.3 | 124.2 |
| L328_15Y | 65.5 | 156.6 | 135.5 |
| P238_08L | 67.4 | 148.0 | 139.7 |
| P271_01G | 68.0 | 150.0 | 144.0 |
| S239_01G | 64.9 | 132.0 | 127.9 |
| S239_09D | 65.0 | 141.9 | 136.6 |
| S267_01G | 67.2 | 116.1 | 112.8 |
| S267_02A | 66.7 | 159.9 | 155.3 |
| S267_07I | 65.7 | 113.2 | 110.8 |
| S337_14T | 67.3 | 110.5 | 110.0 |
| T335_04F | 64.6 | 108.4 | 107.6 |
| T335_06M | 66.2 | 106.7 | 104.7 |
| T335_08L | 64.9 | 108.1 | 108.0 |
| T335_09D | 61.2 | 113.4 | 109.9 |
| Y300_04F | 62.8 | 109.3 | 107.8 |

TABLE 33-1

| NAME | Tm | Ho/Con_2aH | He/Con_2aH |
|---|---|---|---|
| G236_03V | 67.9 | 110.7 | 119.4 |
| G236_07I | 65.6 | 101.0 | 115.2 |
| H268_18N | 66.8 | 110.1 | 112.1 |
| I336_06M | 61.7 | 100.3 | 106.1 |
| I336_07I | 67.9 | 103.6 | 104.8 |
| I336_08L | 64.8 | 100.9 | 105.5 |
| K326_06M | 66.6 | 101.1 | 103.3 |
| K326_10E | 68.0 | 101.0 | 101.8 |
| K326_19Q | 67.9 | 100.5 | 101.4 |
| K334_04F | 65.9 | 103.3 | 105.7 |
| K334_08L | 66.2 | 103.4 | 104.2 |
| K334_16H | 62.8 | 101.4 | 103.9 |
| L235_20W | 67.9 | 111.8 | 117.7 |
| L328_06M | 67.7 | 100.2 | 103.5 |
| L328_14T | 64.9 | 110.3 | 116.2 |
| S239_09D | 65.0 | 112.4 | 114.4 |
| S267_02A | 66.7 | 119.5 | 119.8 |
| S324_02A | 66.3 | 101.5 | 102.5 |
| S337_09D | 56.5 | 106.9 | 107.1 |
| S337_10E | 62.1 | 101.3 | 102.4 |
| T335_01G | 63.2 | 100.9 | 103.1 |
| T335_07I | 67.0 | 105.4 | 107.7 |
| T335_10E | 62.9 | 105.2 | 107.6 |
| T335_13S | 67.6 | 101.4 | 106.1 |
| T335_14T | 68.0 | 104.3 | 107.9 |
| T335_15Y | 64.7 | 101.5 | 106.3 |
| T335_16H | 64.3 | 100.4 | 105.3 |
| T335_19Q | 64.9 | 102.8 | 103.1 |
| A330_12R | 67.9 | 110.2 | 107.7 |
| G236_10E | 65.9 | 121.9 | 111.2 |
| H268_09D | 67.1 | 135.6 | 132.6 |
| H268_10E | 67.6 | 126.4 | 124.3 |
| H268_13S | 67.8 | 113.9 | 112.4 |
| I332_02A | 63.2 | 119.0 | 111.2 |
| I332_03V | 67.8 | 105.6 | 104.7 |
| I332_04F | 61.9 | 111.2 | 104.1 |
| I332_06M | 65.0 | 113.5 | 109.7 |
| I332_09D | 56.2 | 130.4 | 117.7 |
| I332_10E | 60.1 | 117.4 | 108.3 |
| I332_13S | 60.9 | 120.8 | 109.5 |
| I332_14T | 63.1 | 125.1 | 114.9 |
| I332_15Y | 59.4 | 125.7 | 114.5 |
| I332_16H | 60.6 | 118.6 | 109.2 |
| I332_18N | 58.0 | 118.5 | 110.0 |
| I332_19Q | 62.8 | 114.0 | 108.0 |
| K326_09D | 68.0 | 113.3 | 110.3 |
| K326_14T | 64.1 | 118.4 | 114.5 |
| K334_03V | 67.0 | 111.1 | 109.4 |
| K334_07I | 67.3 | 115.5 | 110.1 |
| K334_14T | 65.7 | 105.1 | 103.2 |
| K334_15Y | 65.9 | 110.4 | 106.0 |
| L328_02A | 65.0 | 133.6 | 130.3 |
| L328_13S | 64.5 | 130.6 | 123.2 |
| P271_01G | 68.0 | 110.2 | 107.0 |
| Q295_05P | 64.3 | 106.3 | 103.3 |
| Q295_07I | 66.5 | 108.0 | 102.3 |
| S324_06M | 66.1 | 123.1 | 117.1 |
| S324_09D | 66.2 | 112.8 | 105.7 |
| S324_10E | 66.9 | 104.1 | 102.8 |
| S324_20W | 58.2 | 108.3 | 103.1 |
| S337_14T | 67.3 | 104.7 | 103.3 |
| S337_16H | 66.6 | 101.5 | 101.4 |

TABLE 33-2

| NAME | Tm | Ho/Con_2aH | He/Con_2aH |
|---|---|---|---|
| T335_02A | 65.8 | 103.0 | 100.8 |
| T335_04F | 64.6 | 103.7 | 103.1 |
| T335_05P | 57.1 | 115.0 | 107.6 |
| T335_06M | 66.2 | 106.5 | 102.7 |
| T335_08L | 64.9 | 105.9 | 105.6 |
| T335_09D | 61.2 | 109.5 | 106.9 |
| Y300_06M | 61.9 | 106.3 | 104.8 |

TABLE 33-2-continued

| NAME | Tm | Ho/Con_2aH | He/Con_2aH |
|---|---|---|---|
| Y300_07I | 60.5 | 122.3 | 108.4 |
| Y300_08L | 60.6 | 115.2 | 108.2 |

TABLE 34-1

| NAME | Tm | Ho/Con_2b | He/Con_2b |
|---|---|---|---|
| A330_01G | 67.0 | 102.1 | 103.5 |
| G237_04F | 66.8 | 139.8 | 149.2 |
| G237_20W | 67.6 | 165.7 | 193.4 |
| I332_14T | 63.1 | 105.8 | 106.4 |
| I336_07I | 67.9 | 100.6 | 103.4 |
| I336_08L | 64.8 | 103.0 | 107.4 |
| K326_07I | 66.1 | 169.6 | 198.8 |
| K326_08L | 67.1 | 168.5 | 176.6 |
| K326_20W | 65.5 | 131.8 | 148.5 |
| L235_20W | 67.9 | 116.3 | 147.3 |
| L328_02A | 65.0 | 116.7 | 144.5 |
| L328_13S | 64.5 | 146.6 | 149.2 |
| P238_04F | 66.4 | 209.1 | 312.0 |
| P238_09D | 60.8 | 206.6 | 220.9 |
| P238_15Y | 65.5 | 114.2 | 217.8 |
| P331_15Y | 63.2 | 110.7 | 114.4 |
| P331_16H | 63.0 | 100.4 | 116.0 |
| P331_16H | 61.8 | 110.9 | 111.2 |
| S239_03V | 67.7 | 108.0 | 108.4 |
| S239_10E | 66.0 | 175.1 | 180.6 |
| S267_06M | 66.4 | 186.7 | 209.5 |
| S267_19Q | 66.8 | 184.9 | 217.5 |
| S324_06M | 66.1 | 103.6 | 112.1 |
| S337_16H | 66.6 | 102.7 | 104.6 |
| T335_07I | 67.0 | 104.3 | 106.1 |
| T335_10E | 62.9 | 107.7 | 108.4 |
| T335_14T | 68.0 | 101.9 | 106.6 |
| T335_15Y | 64.7 | 103.9 | 108.2 |
| V266_06M | 64.8 | 231.3 | 251.2 |
| Y296_20W | 66.7 | 102.6 | 103.3 |
| A327_09D | 65.7 | 174.7 | 171.7 |
| A327_10E | 65.4 | 147.8 | 140.5 |
| G236_09D | 66.2 | 206.8 | 167.0 |
| G236_10E | 65.9 | 114.3 | 110.2 |
| H268_01G | 67.5 | 157.6 | 143.6 |
| H268_09D | 67.1 | 297.5 | 239.1 |
| H268_10E | 67.6 | 274.9 | 230.5 |
| H268_13S | 67.8 | 186.0 | 159.6 |
| H268_18N | 66.8 | 178.7 | 156.3 |
| I332_04F | 61.9 | 117.1 | 104.0 |
| I332_06M | 65.0 | 106.4 | 104.7 |
| I332_09D | 56.2 | 181.7 | 147.0 |
| I332_10E | 60.1 | 180.7 | 142.4 |
| I332_15Y | 59.4 | 108.9 | 101.3 |
| K326_03V | 66.5 | 183.5 | 175.3 |
| K326_04F | 65.3 | 159.6 | 155.1 |
| K326_06M | 66.6 | 193.1 | 164.9 |
| K326_09D | 68.0 | 239.8 | 192.9 |
| K326_10E | 68.0 | 237.2 | 200.1 |
| K326_14T | 64.1 | 177.0 | 149.5 |
| K326_15Y | 65.7 | 162.5 | 159.4 |
| K326_16H | 66.7 | 131.2 | 118.7 |
| K326_19Q | 67.9 | 163.0 | 139.3 |
| K334_02A | 65.8 | 109.5 | 107.5 |
| K334_03V | 67.0 | 145.2 | 124.7 |
| K334_04F | 65.9 | 115.0 | 110.9 |
| K334_05P | 62.0 | 112.0 | 105.1 |
| K334_07I | 67.3 | 137.2 | 119.1 |
| K334_08L | 66.2 | 114.0 | 106.5 |
| K334_10E | 63.6 | 129.1 | 114.5 |
| K334_13S | 66.1 | 117.3 | 110.9 |
| K334_14T | 65.7 | 138.4 | 115.4 |

TABLE 34-2

| NAME | Tm | Ho/Con_2b | He/Con_2b |
|---|---|---|---|
| K334_15Y | 65.9 | 126.0 | 109.2 |
| K334_16H | 62.8 | 123.8 | 112.8 |
| K334_18N | 65.4 | 128.0 | 114.8 |
| K334_19Q | 67.1 | 116.8 | 109.3 |
| L328_03V | 64.9 | 135.3 | 125.7 |
| L328_04F | 67.2 | 241.1 | 218.8 |
| L328_06M | 67.7 | 170.8 | 141.6 |
| L328_07I | 66.0 | 188.4 | 160.3 |
| L328_14T | 64.9 | 146.2 | 141.3 |
| L328_15Y | 65.5 | 272.1 | 192.9 |
| L328_19Q | 62.8 | 110.7 | 104.9 |
| P238_08L | 67.4 | 235.3 | 204.5 |
| P271_01G | 68.0 | 228.7 | 193.3 |
| P271_08L | 66.4 | 113.1 | 102.7 |
| P331_04F | 63.0 | 113.1 | 110.5 |
| S239_01G | 64.9 | 173.5 | 144.2 |
| S239_07I | 67.3 | 108.1 | 106.8 |
| S239_08L | 67.6 | 142.1 | 140.3 |
| S239_09D | 65.0 | 223.7 | 205.8 |
| S239_18N | 67.5 | 124.9 | 119.1 |
| S267_02A | 66.7 | 274.1 | 243.3 |
| S267_03V | 66.0 | 206.0 | 192.3 |
| S267_07I | 65.7 | 213.4 | 192.4 |
| S267_08L | 67.3 | 108.9 | 108.8 |
| S267_09D | 65.4 | 326.7 | 310.5 |
| S267_10E | 64.1 | 396.2 | 379.3 |
| S267_14T | 67.8 | 105.5 | 104.4 |
| S298_08L | 65.5 | 114.7 | 108.5 |
| S337_09D | 56.5 | 116.3 | 113.7 |
| S337_10E | 62.1 | 109.0 | 107.3 |
| S337_14T | 67.3 | 109.8 | 104.6 |
| T335_04F | 64.6 | 106.8 | 102.9 |
| T335_08L | 64.9 | 106.0 | 103.9 |
| T335_09D | 61.2 | 116.0 | 108.4 |
| Y300_19Q | 63.0 | 124.0 | 108.3 |

TABLE 35-1

| NAME | Tm | Ho/Con_3a | He/Con_3a |
|---|---|---|---|
| I332_01G | 56.8 | 103.6 | 110.7 |
| I336_02A | 61.8 | 103.6 | 111.0 |
| I336_03V | 67.2 | 110.0 | 112.2 |
| I336_06M | 61.7 | 107.0 | 108.9 |
| I336_07I | 67.9 | 100.2 | 103.1 |
| I336_18N | 62.0 | 100.6 | 104.0 |
| K326_07I | 66.1 | 133.5 | 138.6 |
| K326_08L | 67.1 | 113.9 | 114.2 |
| K334_01G | 64.2 | 103.6 | 121.4 |
| K334_09D | 65.6 | 149.7 | 159.7 |
| Q295_14T | 65.9 | 108.2 | 114.7 |
| S267_02A | 66.7 | 145.3 | 150.4 |
| S267_09D | 65.4 | 159.7 | 180.8 |
| S298_14T | 66.1 | 106.7 | 112.6 |
| S337_09D | 56.5 | 105.5 | 109.9 |
| S337_10E | 62.1 | 100.2 | 105.0 |
| S337_18N | 64.1 | 101.5 | 104.1 |
| T335_07I | 67.0 | 107.0 | 107.2 |
| T335_10E | 62.9 | 102.4 | 106.9 |
| T335_14T | 68.0 | 102.5 | 108.5 |
| A330_04F | 67.3 | 174.3 | 147.1 |
| A330_08L | 66.9 | 138.4 | 124.5 |
| A330_20W | 67.9 | 117.9 | 104.2 |
| E333_16H | 60.8 | 110.9 | 103.0 |
| H268_09D | 67.1 | 220.3 | 197.2 |
| H268_10E | 67.6 | 205.5 | 186.1 |
| H268_13S | 67.8 | 129.6 | 121.9 |
| I332_02A | 63.2 | 114.1 | 112.3 |
| I332_09D | 56.2 | 254.6 | 206.6 |
| I332_10E | 60.1 | 278.5 | 232.7 |
| I332_13S | 60.9 | 112.3 | 104.5 |
| I332_14T | 63.1 | 138.3 | 119.8 |
| I332_15Y | 59.4 | 105.6 | 101.0 |
| I332_19Q | 62.8 | 118.4 | 110.5 |
| I336_09D | 53.5 | 110.9 | 106.3 |
| I336_10E | 53.8 | 130.0 | 119.4 |
| I336_13S | 57.4 | 119.4 | 101.6 |
| I336_14T | 64.1 | 122.7 | 108.3 |
| K326_03V | 66.5 | 137.0 | 122.1 |
| K326_04F | 65.3 | 102.9 | 102.9 |
| K326_06M | 66.6 | 128.9 | 114.8 |
| K326_09D | 68.0 | 162.7 | 133.6 |
| K326_10E | 68.0 | 157.2 | 124.5 |
| K326_14T | 64.1 | 147.4 | 126.5 |
| K326_15Y | 65.7 | 115.4 | 112.3 |
| K326_19Q | 67.9 | 117.7 | 106.3 |
| K334_02A | 65.8 | 154.2 | 147.2 |
| K334_03V | 67.0 | 169.7 | 149.5 |
| K334_04F | 65.9 | 168.0 | 147.5 |
| K334_05P | 62.0 | 164.6 | 133.7 |
| K334_07I | 67.3 | 179.9 | 151.1 |
| K334_08L | 66.2 | 178.0 | 143.3 |
| K334_10E | 63.6 | 206.0 | 180.6 |
| K334_13S | 66.1 | 153.2 | 145.3 |
| K334_14T | 65.7 | 163.4 | 141.4 |
| K334_15Y | 65.9 | 180.9 | 140.8 |
| K334_16H | 62.8 | 152.9 | 133.7 |
| K334_18N | 65.4 | 155.9 | 136.2 |
| K334_19Q | 67.1 | 149.5 | 136.1 |
| Q295_02A | 66.5 | 107.5 | 105.6 |
| Q295_10E | 64.9 | 111.2 | 100.2 |
| S239_09D | 65.0 | 192.1 | 165.5 |

TABLE 35-2

| NAME | Tm | Ho/Con_3a | He/Con_3a |
|---|---|---|---|
| S239_10E | 66.0 | 251.9 | 181.4 |
| S239_18N | 67.5 | 115.9 | 109.9 |
| S298_03V | 65.0 | 110.1 | 109.3 |
| S324_01G | 65.4 | 119.4 | 104.9 |
| S324_06M | 66.1 | 114.1 | 112.7 |
| S324_09D | 66.2 | 101.1 | 101.0 |
| S324_14T | 67.1 | 108.5 | 103.1 |
| S324_20W | 58.2 | 101.9 | 101.8 |
| S337_01G | 64.9 | 108.1 | 102.2 |
| S337_16H | 66.6 | 112.3 | 107.7 |
| T335_05P | 57.1 | 118.8 | 104.9 |
| T335_06M | 66.2 | 107.2 | 101.5 |
| T335_08L | 64.9 | 102.9 | 102.4 |
| T335_09D | 61.2 | 113.8 | 107.7 |
| Y296_20W | 66.7 | 145.7 | 135.0 |
| Y300_08L | 60.6 | 104.9 | 104.9 |

[Example 11] ADCC Activity Assay of Heterodimerized Antibodies with Improved Ability to Recognize FcγRIIIa As discussed in Example 7, by using the heterodimerized antibody, the FcγRIIIa-binding activity was successfully increased more than that of variants produced by the conventional homodimerized antibody technology. Antibodies induce NK cells via FcγRIIIa to exhibit antibody-dependent cellular cytotoxicity against cells expressing the target antigen. To assess whether the heterodimerized antibodies have not only increased FcγRIIIa-binding activity but also increased ADCC activity, the heterodimerized antibodies with increased FcγRIIIa-binding activity shown in Table 13 of Example 7, homodimerized antibodies, and native IgG1 were assayed for ADCC activity according to the method described in Reference Example 7. The result is shown in FIG. 31.

Based on the result shown in FIG. 31, when GpH7-G1d/GpL16-k0 which is a native IgG1 is compared to GpH7-A5/GpH7-B3/GpL16-k0 in which D356K, H435R, and K439E each was introduced into one H chain, there is no significant difference in the ADCC activity. Thus, it was thought that the alterations D356K, H435R, and K439E do not affect the ADCC activity.

Then, homodimerized antibodies in which an alteration that increases the FcγRIIIa-binding activity was introduced into both H chains in the conventional way, were examined to assess whether the same tendency as seen in the binding enhancing effect is also observed for the ADCC activity. GpH7-TA7/GpH7-TA45/GpL16-k0 in which both of the H chains were introduced with L234Y, G236W, and S298A was compared to GpH7-A57/GpH7-B78/GpL16-k0 in which both of the H chains were introduced with S239D, A330L, and I332E. Regarding the FcγRIIIa-binding activity, the binding of GpH7-A57/GpH7-B78/GpL16-k0 was markedly enhanced as compared to GpH7-A5/GpH7-B3/GpL16-k0, while the binding of GpH7-TA7/GpH7-TA45/GpL16-k0 was reduced. Likewise, the ADCC activity of GpH7-A57/GpH7-B78/GpL16-k0 was increased more than that of GpH7-A5/GpH7-B3/GpL16-k0, while the activity of GpH7-TA7/GpH7-TA45/GpL16-k0 was reduced compared to GpH7-A5/GpH7-B3/GpL16-k0. Thus, as to the homodimerized antibodies, a correlation was observed between the level of the FcγRIIIa-binding activity and that of the ADCC activity.

Then, heterodimerized antibodies in which only one of the H chains was introduced with an alteration that increases the FcγRIIIa-binding activity were examined to assess whether the same tendency as seen in the binding enhancing effect is observed for the ADCC activity. GpH7-TA7/GpH7-B3/GpL16-k0 in which one of the H chains was introduced with L234Y, G236W, and S298A was compared to GpH7-A5/GpH7-B78/GpL16-k0 in which one of the H chains was introduced with S239D, A330L, and I332E. The FcγRIIIa-binding activities of GpH7-A5/GpH7-B78/GpL16-k0 and GpH7-TA7/GpH7-B3/GpL16-k0 were increased as compared to GpH7-A5/GpH7-B3/GpL16-k0. The same tendency was observed for the ADCC activity. Furthermore, the FcγRIIIa-binding activity of GpH7-A5/GpH7-B78/GpL16-k0 was increased more than that of GpH7-TA7/GpH7-B3/GpL16-k0; however, the same tendency was obtained for ADCC activity. Thus, not only the homodimerized antibodies but also the heterodimerized antibodies have a correlation between the level of the FcγRIIIa-binding activity and the ADCC activity.

Then, regarding each of the groups of the alterations L234Y, G236W, and S298A, and the alterations S239D, A330L, and I332E, it was assessed whether heterodimerized antibodies and homodimerized antibodies have a correlation between the effects to enhance the FcγRIIIa-binding activity and ADCC activity. First, when GpH7-A5/GpH7-B78/GpL16-k0 which is a heterodimerized antibody in which only one the H chains was introduced with the group of the alteration S239D, A330L, and I332E was compared to GpH7-A57/GpH7-B78/GpL16-k0 which is a homodimerized antibody in which both of the H chains were introduced with the group, the effect to enhance the FcγRIIIa-binding activity was greater in the homodimerized antibody than the heterodimerized antibody; however, there was no difference for the ADCC activity. Furthermore, when GpH7-TA7/GpH7-B3/GpL16-k0 which is a heterodimerized antibody in which only one of the H chains was introduced with the group of the alterations L234Y, G236W, and S298A was compared to GpH7-TA7/GpH7-TA45/GpL16-k0 which is a homodimerized antibody in which both of the H chains were introduced with the group, with respect to the FcγRIIIa-binding activity, the binding of the heterodimerized antibody was enhanced more strongly than that of GpH7-A5/GpH7-B3/GpL16-k0, whereas the binding of the homodimerized antibody was reduced. The same tendency was observed for the ADCC activity. Thus, it was thought that the effect of the group of the alterations L234Y, G236W, and S298A to increase the FcγRIIIa-binding activity from only one direction is reflected in the ADCC activity. From these results, it was thought that in heterodimerized antibodies in which only one of the H chains has been introduced with a group of alterations, and homodimerized antibodies in which both of the H chains have been introduced with the group, there is a correlation between the level of the FcγRIIIa-binding activity and the ADCC activity.

Next, the heterodimerized antibody GpH7-TA7/GpH7-B78/GpL16-k0 in which one of the H chains was introduced with L234Y, G236W, and S298A and the other H chain was introduced with S239D, A330L, and I332E was compared to the homodimerized antibody GpH7-A57/GpH7-B78/GpL16-k0 in which both of the H chains were introduced with S239D, A330L, and I332E. Regarding the FcγRIIIa-binding activity, both had markedly increased binding activities as compared to GpH7-A5/GpH7-B3/GpL16-k0. The same tendency was observed for the ADCC activity. In addition, the FcγRIIIa-binding activity of GpH7-TA7/GpH7-B78/GpL16-k0 was increased more than that of GpH7-A57/GpH7-B78/GpL16-k0, and GpH7-TA7/GpH7-B78/GpL16-k0 also exhibited a stronger ADCC activity.

As described above, regarding the groups of the alterations L234Y, G236W, and S298A, and the alterations S239D, A330L, and I332E, the latter alteration group, S239D, A330L, and I332E, was observed to have a stronger effect to increase the ADCC activity regardless of when introduced into one H chain or both H chains. On the other hand, it was demonstrated that, when the group of alterations L234Y, G236W, and S298A, and the group of the alterations S239D, A330L, and I332E are respectively introduced into different H chains, the effect to increase the ADCC activity is stronger than when S239D, A330L, and I332E, which have a strong effect to increase the ADCC activity in both heterodimerized and homodimerized antibodies, are introduced into both H chains.

That is, it was demonstrated that the correlation between the level of the FcγRIIIa-binding activity and the ADCC level, such as that observed in homodimerized antibodies of the prior art technology, is also observed when comparing heterodimerized antibodies to one another and when comparing heterodimerized and homodimerized antibodies. This reveals that the use of the heterodimerized antibody technology enables the preparation of antibodies having ADCC activity superior to those by conventional technologies.

[Example 12] Comparison of Conventional Homodimerized Antibodies and Novel Heterodimerized Antibodies in Connection with FcγRIIa As described in Example 1, FcγRIIIa is thought to play an important role in the drug efficacy of antibody pharmaceuticals. Furthermore, attention has been drawn on the role of FcγRIIa that is played in the drug efficacy of IgG1-derived antibody pharmaceuticals, in addition to FcγRIIIa.

For FcγRIIa, there are allotypes called R and H types, which have Arg and His at amino acid position 131, respectively, and they are known to differ in the human IgG2-binding activity (Tissue Antigens 2003, 61, 189-202). The susceptibility to infection is known to vary depending on the difference in the FcγRIIa allotype (Tissue Antigens 2003:

61: 189-202). This is thought to be because the IgG2-binding activity of FcγRIIa varies depending on the difference in the allotype, and as a result the mechanism of resistance to pathogens via IgG2 differs (Infection and Immunity 1995, 63, 73-81). Meanwhile, cells expressing mouse FcγRTV are known to correspond to cells expressing human FcγRIIa, and FcγRIV has been reported to play an important role in the drug efficacy of an anti-CD20 antibody in mouse model. These findings suggest that, in human, FcγRIIa plays a similar role (The Journal of Experimental Medicine 2004: 199: 1659-1669; The Journal of Experimental Medicine 2006, 203, 743-753; Immunity 2005, 23, 41-51). Indeed, it has been reported that, an antibody in which the FcγRIIa-binding activity of the Fc region is enhanced compared with IgG1 enhances the macrophage-mediated antibody-dependent cellular phagocytosis (ADCP) activity as compared to IgG1 (Molecular Cancer Therapeutics 2008, 7, 2517-2527). Furthermore, in a mouse xenograft model, an anti-CD 19 antibody having an Fc domain with enhanced ADCP exhibits an antitumor effect stronger than that of IgG1 (Nature Medicine 2000, 6, 443-446). The Fc domain of this antibody has increased binding activity to monkey FcγRIIa. CD19 is expressed on B cell surface. It has been reported that this antibody, when administered to monkeys, enhances the B cell elimination as compared to an anti-CD19 antibody having the Fc region of IgG1 (Science 2005, 310, 1510-1512).

From these reports, it is expected that the efficacy of antibody pharmaceuticals, in particular, the antitumor effect can be further improved by increasing the FcγRIIa-binding activity in addition to enhancing the FcγRIIIa-binding activity. Antibodies with such characteristics have been produced using conventional technologies (Molecular Cancer Therapeutics 2008, 7, 2517-2527). However, since FcγRIIa is thought to bind to an antibody Fc domain in an asymmetric manner, it is considered that the FcγRIIa-binding activity can be further increased by using the heterodimerized antibody technology as described in Example 11. To assess this, alterations that increase the binding activity to all of FcγRIIIa, FcgRIIa R type, and FcgRIIa H type as compared to native IgG were selected based on the result shown in Example 4, and combined them to introduce the mutations that enhancing the binding activity to all of FcγRIIIa, FcgRIIa R type, and FcgRIIa H type, and heterodimerized antibodies were produced to have a combination of H chains with differential FcγR binding. The antibodies were assessed for the binding activity to each FcγR.

Meanwhile, in contrast to these activating FcγR, FcγRIIb which is an inhibitory FcγR induces intracellular signal that suppresses the immune response. It has been reported that in FcγRIIb-knockout mice the antitumor effect of antibodies is enhanced (Nature Medicine 2000, 6, 443-446) and antibody-mediated B cell elimination is promoted (The Journal of Experimental Medicine 2006, 203, 743-753), showing that FcγRIIb plays an important role in the drug efficacy of antibodies in vivo. Meanwhile, a correlation has been observed between the antitumor effect of mouse IgG subclass and the ratio of the binding activity to activating FcγR against the binding activity to inhibitory FcγR (A/I ratio) of each IgG subclass (Science 2005, 310, 1510-1512). These reports suggest that A/I ratios are important for antibody effector function via immunity. Specifically, when antibodies are produced to have higher A/I ratio, their effector function is enhanced, and such antibodies are useful. It was, however, predicted to be extremely difficult to increase the A/I ratio by increasing the FcγRIIa-binding activity without increasing the FcγRIIb-binding activity, because the sequence homology between FcγRIIa which is an activating FcγR, and FcγRIIb which is an inhibitory FcγR is 93%, which is extremely high, at their extracellular domains. Like FcγRIIIa and FcγRIIa, FcγRIIb is thought to bind to an antibody Fc domain in an asymmetric manner. With conventional technologies, the interaction with FcγR can be regulated only by introducing the same alteration into both H chains of an antibody. In contrast, the use of the heterodimerized antibody technology enables more precise regulation, and thus enables improvement of the A/I ratio even between FcγRIIa and FcγRIIb whose sequences are highly similar. Thus, the present inventors also assessed, from this viewpoint, whether the heterodimerized antibody technology is superior to conventional technologies.

In this assessment, to efficiently form heterodimerized antibodies, the knobs-into-holes technology was used for the antibody H chain constant region. The knobs-into-holes technology is a technology that enables promotion of heterodimerization of H chains and efficient preparation of heterodimerized antibodies of interest by substituting an amino acid side chain with a larger side chain (knob) in the CH3 domain of one H chain and substituting an amino acid side chain with a smaller side chain (hole) in the CH3 domain of the other H chain so that the knob is placed in the hole (Nature, 372, 379-383 (1994)). An H chain whose constant region has been introduced with the alterations Y349C and T366W that intend to have larger amino acid side chains in the CH3 domain is referred to as "knob chain". When an additional alteration is introduced into this, the name of the H chain constant region begins with symbol "Kn", which is followed by three-digit number, such as Kn001. An H chain whose constant region has been introduced with the alterations D356C, T366S, L368A, and Y407V that intend to have smaller amino acid side chains in the CH3 domain is referred to as "hole chain". When an additional alteration is introduced into this, the name of the H chain constant region begins with symbol "Hl", which is followed by three-digit number, and thus is referred to as, such as Hl001. Furthermore, when the antibody H chain constant regions are Kn001 and Hl001, the sequences of the H chains of an antibody whose variable regions have GpH7 are referred to as GpH7-Kn001 and GpH7-Hl001, respectively. An antibody purified after expression is referred to, for example, as GpH7-Kn001/GpH7-Hl001/GpL16-k0 when the sequence corresponding to an antibody H chain used to express the heterodimerized antibody is GpH7-Kn001, and the sequence corresponding to the other antibody H chain is GpH7-Hl001, and the sequence corresponding to the antibody L chain is GpL16-k0.

First, GpH7-Kn033 (SEQ ID NO: 51) resulting from the introduction of the alterations Y349C and T366W into the constant region for GpH7-G1d, and GpH7-Hl033 (SEQ ID NO: 56) resulting from the introduction of the alterations D356C, T366S, L368A, and Y407V into constant region for GpH7-G1d were constructed according to the method described in Reference Example 1. When expressing heterodimerized antibodies, the following expression vectors were used for efficient expression of them:
an expression vector inserted with GpL16-k0 for the antibody L chain; for one antibody H chain, an expression vector inserted with a sequence introduced with a further alteration to GpH7-Kn033 (SEQ ID NO: 51) introduced with the alterations Y349C and T366W; and, for the other antibody H chain, an expression vector inserted with a sequence introduced with a further alteration to GpH7-Hl033 (SEQ ID NO: 56) introduced with the alterations D356C, T366S, L368A, and Y407V.

Antibodies whose binding to all of FcγRIIIa, FcγRIIa R type, and FcγRIIa H type is intended to be enhanced were produced as described below, based on the information obtained in Example 4 on the influence of each alteration on the binding of an antibody to each FcγR. When introducing different alterations into the constant regions of respective H chains of an antibody, GpH7-Kn033 and GpH7-Hl033 were used as parental polypeptides. GpH7-Kn045 (SEQ ID NO: 54) resulting from the introduction of L234Y, L235Y, G236A, H268D, and S298A into GpH7-Kn033; GpH7-Kn056 (SEQ ID NO: 55) resulting from the introduction of L234Y, L235Y, G236A, H268D, Q295L, and S298A into GpH7-Kn033; GpH7-Hl048 (SEQ ID NO: 59) resulting from the introduction of G236A, S239D, A330K, and I332E into GpH7-Hl033; and GpH7-Hl055 (SEQ ID NO: 60) resulting from the introduction of G236A, S239D, Q295L, A330M, and I332E into GpH7-Hl033, were constructed according to the method described in Reference Example 1.

Then, respective H chains were combined in the manner described below, and the antibodies were expressed according to Reference Example 1. GpH7-Kn033/GpH7-Hl033/GpL16-k0 resulting from the application of the knobs-into-holes technology alone to G1d was expressed using GpH7-Kn033 and GpH7-Hl033 as the H chain and GpL16-k0 as the L chain. The heterodimerized antibody GpH7-Kn045/GpH7-Hl048/GpL16-k0 was expressed using GpH7-Kn045 and GpH7-Hl048 as the H chain and GpL16-k0 as the L chain. The heterodimerized antibody GpH7-Kn045/GpH7-Hl055/GpL16-k0 was expressed using GpH7-Kn045 and GpH7-Hl055 as the H chain and GpL16-k0 as the L chain. The heterodimerized antibody GpH7-Kn056/GpH7-Hl055/GpL16-k0 was expressed using GpH7-Kn056 and GpH7-Hl055 as the H chain and GpL16-k0 as the L chain.

Antibodies based on the use of conventional technologies for comparison were prepared with reference to Pro. Nat. Acad. Sci., 103, 4005-4010 (2006) as described below. The alteration G236A/S239D/I332E, which has been reported to enhance the binding to all of FcγRIIIa, FcγRIIa R type, and FcγRIIa H type, was introduced into GpH7-Kn033 and GpH7-Hl033 to construct GpH7-Kn037 (SEQ ID NO: 52) and GpH7-Hl036 (SEQ ID NO: 57), respectively. Furthermore, the alteration S239D/A330L/I332E, which has been reported to enhance the FcγRIIIa binding, was introduced into GpH7-Kn033 and GpH7-Hl033 to construct GpH7-Kn032 (SEQ ID NO: 53) and GpH7-Hl032 (SEQ ID NO: 58), respectively. These H chains were combined, and antibodies were expressed according to Reference Example 1. The homodimerized antibody GpH7-Kn037/GpH7-Hl036/GpL16-k0, resulting from the introduction of G236A/S239D/I332E into both H chains of GpH7-Kn033/GpH7-Hl033/GpL16-k0, which is a molecule resulting from the application of the knobs-into-holes technology alone to G1d, was expressed using GpH7-Kn037 and GpH7-Hl036 as the H chain and GpL16-k0 as the L chain. The homodimerized antibody GpH7-Kn032/GpH7-Hl032/GpL16-k0, resulting from the introduction of S239D/A330L/I332E into both H chains of GpH7-Kn033/GpH7-Hl033/GpL16-k0, which is a molecule resulting from the application of the knobs-into-holes technology alone to G1d, was expressed using GpH7-Kn032 and GpH7-Hl032 as the H chain and GpL16-k0 as the L chain.

These antibodies were assessed for the binding activity to each FcγR according to the method described in Reference Example 2. The result is summarized in Table 36. Meanwhile, the KD ratio of each antibody is shown in Table 37, and the A/I ratio, which is the KD ratio for FcγRIIIa, is summarized in Table 38.

TABLE 36

| SAMPLE | Knob | MUTATION SITE | Hole | MUTATION SITE | FcgRIa KD (M) | FcgRIIa H KD (M) | FcgRIIa R KD (M) | FcgRIIb KD (M) | FcgRIIIa F KD (M) | FcgRIIIa V KD (M) |
|---|---|---|---|---|---|---|---|---|---|---|
| GpH7-Kn033/GpH7-Hl033/GpL16-k0 (SEQ ID NO: 51, 56, 5) | Kn033 | — | Hl033 | — | 6.9E−11 | 5.9E−07 | 7.4E−07 | 3.6E−06 | 1.6E−06 | 2.2E−07 |
| GpH7-Kn037/GpH7-Hl036/GpL16-k0 (SEQ ID NO: 52, 57, 5) | Kn037 | G236A/ S239D/ I332E | Hl036 | G236A/ S239D/ I332E | 1.2E−11 | 2.7E−08 | 1.7E−08 | 2.3E−07 | 9.7E−09 | 2.6E−09 |
| GpH7-Kn032/GpH7-Hl032/GpL16-k0 (SEQ ID NO: 53, 58, 5) | Kn032 | S239D/ A330L/ I332E | Hl032 | S239D/ A330L/ I332E | 2.8E−12 | 4.7E−07 | 2.5E−07 | 4.4E−07 | 4.1E−09 | 1.2E−09 |
| GpH7-Kn045/GpH7-Hl048/GpL16-k0 (SEQ ID NO: 54, 59, 5) | Kn045 | L234Y/ L235Y/ G236A/ H268D/ S298A | Hl048 | G236A/ S239D/ A330K/ I332E | 1.9E−11 | 1.1E−08 | 4.8E−09 | 1.1E−07 | 3.7E−09 | 1.3E−09 |
| GpH7-Kn045/GpH7-Hl055/GpL16-k0 (SEQ ID NO: 54, 60, 5) | Kn045 | L234Y/ L235Y/ G236A/ H268D/ S298A | Hl055 | G236A/ S239D/ Q295L/ A330M/ I332E | 1.9E−11 | 2.9E−08 | 1.3E−08 | 2.4E−07 | 1.6E−09 | 7.2E−10 |
| GpH7-Kn056/GpH7-Hl055/GpL16-k0 (SEQ ID NO: 55, 60, 5) | Kn056 | L234Y/ L235Y/ G236A/ H268D/ Q295L/ S298A | Hl055 | G236A/ S239D/ Q295L/ A330M/ I332E | 2.3E−11 | 3.0E−08 | 1.7E−08 | 2.6E−07 | 1.4E−09 | 6.6E−10 |

The table shows the binding activity to each FcγR of heterodimerized antibodies with enhanced binding to FcγRIIa and IIIa.

The column "SAMPLE" indicates antibody names; the columns "Kn" and "Hl" indicate names of the constant regions of the knob chain and hole chain of each antibody; and the column "MUTATION SITE" indicates mutations that are different in comparison with GpH7-Kn033/GpH7-Hl033/GpL16-k0 ("-": when there is no particular mutation).

TABLE 37

| SAMPLE | Knob | MUTATION SITE | Hole | MUTATION SITE | FcgRIa KD ratio | FcgRIIa H KD ratio | FcgRIIa R KD ratio | FcgRIIb KD ratio | FcgRIIIa F KD ratio | FcgRIIIa V KD ratio |
|---|---|---|---|---|---|---|---|---|---|---|
| GpH7-Kn033/GpH7-Hl033/GpL16-k0 (SEQ ID NO: 51, 56, 5) | Kn033 | — | Hl033 | — | 1 | 1 | 1 | 1 | 1 | 1 |
| GpH7-Kn037/GpH7-Hl036/GpL16-k0 (SEQ ID NO: 52, 57, 5) | Kn037 | G236A/ S239D/ I332E | Hl036 | G236A/ S239D/ I332E | 6 | 22 | 43 | 16 | 161 | 84 |
| GpH7-Kn032/GpH7-Hl032/GpL16-k0 (SEQ ID NO: 53, 58, 5) | Kn032 | S239D/ A330L/ I332E | Hl032 | S239D/ A330L/ I332E | 24 | 1.2 | 3.0 | 8.2 | 381 | 182 |
| GpH7-Kn045/GpH7-Hl048/GpL16-k0 (SEQ ID NO: 54, 59, 5) | Kn045 | L234Y/ L235Y/ G236A/ H268D/ S298A | Hl048 | G236A/ S239D/ A330K/ I332E | 3.7 | 52 | 154 | 34 | 419 | 170 |
| GpH7-Kn045/GpH7-Hl055/GpL16-k0 (SEQ ID NO: 54, 60, 5) | Kn045 | L234Y/ L235Y/ G236A/ H268D/ S298A | Hl055 | G236A/ S239D/ Q295L/ A330M/ I332E | 3.7 | 21 | 56 | 15 | 985 | 300 |
| GpH7-Kn056/GpH7-Hl055/GpL16-k0 (SEQ ID NO: 55, 60, 5) | Kn056 | L234Y/ L235Y/ G236A/ H268D/ Q295L/ S298A | Hl055 | G236A/ S239D/ Q295L/ A330M/ I332E | 2.9 | 20 | 44 | 14 | 1114 | 327 |

The table shows the binding activity to each FcγR of heterodimerized antibodies with enhanced binding to FcγRIIa and Ma.

The column "SAMPLE" indicates antibody names; the columns "Kn" and "Hl" indicate names of the constant regions of the knob chain and hole chain of each antibody; and the column "MUTATION SITE" indicates mutations that are different in comparison with GpH7-Kn033/GpH7-Hl033/GpL16-k0 ("-": when there is no particular mutation). A value obtained by dividing KD of GpH7-Kn033/GpH7-Hl033/GpL16-k0 for FcγR by the KD of each antibody was defined as "KD ratio". The SEQ ID NOs are also shown for the amino acid sequences of the H chain and L chain of each antibody.

The table shows the ratio between the binding activity to activating FcγR and the binding activity to inhibitory FcγR.

The column "SAMPLE" indicates antibody names; the columns "Kn" and "Hl" indicate names of the constant regions of the knob chain and hole chain of each antibody; and the column "MUTATION SITE" indicates mutations that are different in comparison with GpH7-Kn033/GpH7-Hl033/GpL16-k0 ("-": when there is no particular mutation). A value obtained by dividing KD of GpH7-Kn033/GpH7-Hl033/GpL16-k0 for FcγRIIb by the KD of each antibody for FcγRIIa H type and R type was defined as "A/I ratio" for each type. The SEQ ID NOs are also shown for the amino acid sequences of the H chain and L chain of each antibody.

TABLE 38

| SAMPLE | Knob | MUTATION SITE | Hole | MUTATION SITE | A/I ratio FcgRIIa H | A/I ratio FcgRIIa R |
|---|---|---|---|---|---|---|
| GpH7-Kn033/GpH7-Hl033/GpL16-k0 (SEQ ID NO: 51, 56, 5) | Kn033 | — | Hl033 | — | 6.2 | 4.9 |
| GpH7-Kn037/GpH7-Hl036/GpL16-k0 (SEQ ID NO: 52, 57, 5) | Kn037 | G236A/S239D/ I332E | Hl036 | G236A/S239D/ I332E | 8.6 | 13 |
| GpH7-Kn032/GpH7-Hl032/GpL16-k0 (SEQ ID NO: 53, 58, 5) | Kn032 | S239D/A330L/ I332E | Hl032 | S239D/A330L/ I332E | 0.93 | 1.8 |
| GpH7-Kn045/GpH7-Hl048/GpL16-k0 (SEQ ID NO: 54, 59, 5) | Kn045 | L234Y/L235Y/ G236A/H268D/ S298A | Hl048 | G236A/S239D/ A330K/I332E | 9.5 | 22 |
| GpH7-Kn045/GpH7-Hl055/GpL16-k0 (SEQ ID NO: 54, 60, 5) | Kn045 | L234Y/L235Y/ G236A/H268D/ S298A | Hl055 | G236A/S239D/ Q295L/A330M/ I332E | 8.3 | 18 |
| GpH7-Kn056/GpH7-Hl055/GpL16-k0 (SEQ ID NO: 55, 60, 5) | Kn056 | L234Y/L235Y/ G236A/H268D/ Q295L/S298A | Hl055 | G236A/S239D/ Q295L/A330M/ I332E | 8.7 | 16 |

The results shown in Tables 36 and 37 demonstrate that, regarding GpH7-Kn037/GpH7-Hl036/GpL16-k0 in which both of the H chains were introduced with G236A/S239D/I332E, its binding to FcγRIIa type H was enhanced by 22 times, its binding to FcγRIIa type R was enhanced by 43 times, and its binding to FcγRIIIa F was enhanced by 161 times as compared to GpH7-Kn033/GpH7-Hl033/GpL16-k0 which is a molecule resulting from the application of the knobs-into-holes technology alone to G1d. Meanwhile, the result shown in Table 38 demonstrates that the A/I ratio of GpH7-Kn037/GpH7-Hl036/GpL16-k0 was 8.6 for FcγRIIa type H and 13 for FcγRIIa type R, which were increased as compared to, respectively, 6.2 and 4.9 of GpH7-Kn033/GpH7-Hl033/GpL16-k0.

The results shown in Tables 36 and 37 demonstrate that, regarding GpH7-Kn032/GpH7-Hl032/GpL16-k0 in which both of the H chains were introduced with S239D/A330L/I332E, its binding to FcγRIIa type H was enhanced by 1.2 times, its binding to FcγRIIa type R was enhanced by 3.0 times, and its binding to FcγRIIIa F was enhanced by 381 times as compared to GpH7-Kn033/GpH7-Hl033/GpL16-k0 which is a molecule resulting from the application of the knobs-into-holes technology alone to G1d. Meanwhile, the result shown in Table 38 demonstrates that the A/I ratio of GpH7-Kn032/GpH7-Hl032/GpL16-k0 was 0.93 for FcγRIIa type H and 1.8 for FcγRIIa type R, which were decreased as compared to GpH7-Kn033/GpH7-Hl033/GpL16-k0.

The results shown in Tables 36 and 37 demonstrate that, regarding GpH7-Kn045/GpH7-Hl048/GpL16-k0 in which one of the H chains was introduced with L234Y/L235Y/G236A/H268D/S298A and the other H chain with G236A/S239D/A330K/I332E, its binding to FcγRIIa type H was enhanced by 52 times, its binding to FcγRIIa type R was enhanced by 154 times, and its binding to FcγRIIIa F was enhanced by 419 times as compared to GpH7-Kn033/GpH7-Hl033/GpL16-k0 which is a molecule resulting from the application of the knobs-into-holes technology alone to G1d. The result also shows that, for both H and R types, the FcγRIIa-binding activity was increased as compared to the homodimerized antibody GpH7-Kn037/GpH7-Hl036/GpL16-k0 in which both of the H chains were introduced with G236A/S239D/I332E of the prior art technology. In addition, the FcγRIIIa F-binding activity was slightly increased as compared to the homodimerized antibody GpH7-Kn032/GpH7-Hl032/GpL16-k0 in which both of the H chains were introduced with S239D/A330L/I332E of the prior art technology. The result shown in Table 38 demonstrates that the A/I ratio of GpH7-Kn045/GpH7-Hl048/GpL16-k0 was 9.5 for FcγRIIa type H and 22 for FcγRIIa type R, which were increased when compared to any of GpH7-Kn033/GpH7-Hl033/GpL16-k0, GpH7-Kn037/GpH7-Hl036/GpL16-k0, and GpH7-Kn032/GpH7-Hl032/GpL16-k0. The result demonstrates that, using the heterodimerized antibody technology, the FcγRIIa- and FcγRIIIa F-binding activities of GpH7-Kn045/GpH7-Hl048/GpL16-k0 are increased and the antibody binds more selectively to activating FcγR, as compared to when using the conventional technology.

The results shown in Tables 36 and 37 demonstrate that, regarding GpH7-Kn045/GpH7-Hl055/GpL16-k0 in which one of the H chains was introduced with L234Y/L235Y/G236A/H268D/S298A and the other H chain was introduced with G236A/S239D/Q295L/A330M/I332E, its binding to FcγRIIa type H was enhanced by 21 times, its binding to FcγRIIa type R was enhanced by 56 times, and its binding to FcγRIIIa F was enhanced by 985 times as compared to GpH7-Kn033/GpH7-Hl033/GpL16-k0 which is a molecule resulting from the application of the knobs-into-holes technology alone to G1d. The result also shows that, for both H and R types, the FcγRIIa-binding activity was almost equivalent to that of the homodimerized antibody GpH7-Kn037/GpH7-Hl036/GpL16-k0 in which both of the H chains were introduced with G236A/S239D/I332E of the prior art technology. The FcγRIIIa F-binding activity was increased as compared to the homodimerized antibody GpH7-Kn032/GpH7-Hl032/GpL16-k0 in which both of the H chains were introduced with S239D/A330L/I332E of the prior art technology. The result shown in Table 38 demonstrates that the A/I ratio of GpH7-Kn045/GpH7-Hl055/GpL16-k0 was 8.3 for FcγRIIa type H and 18 for FcγRIIa type R, which was increased as compared to GpH7-Kn033/GpH7-Hl033/GpL16-k0 and GpH7-Kn032/GpH7-Hl032/GpL16-k0; and as compared to GpH7-Kn037/GpH7-Hl036/GpL16-k0, it was almost equivalent for FcγRIIa type H and increased for FcγRIIa type R. This result demonstrates that, using the heterodimerized antibody technology, in GpH7-Kn045/GpH7-Hl055/GpL16-k0, the FcγRIIIa-binding activity is further increased while its FcγRIIa-binding activity is increased to a comparable extent, and the antibody binds more selectively to activating FcγR, as compared to when using the conventional technology.

The results shown in Tables 36 and 37 demonstrate that, regarding GpH7-Kn056/GpH7-Hl055/GpL16-k0 in which one of the H chains was introduced with L234Y/L235Y/G236A/H268D/Q295L/S298A and the other H chain was introduced with G236A/S239D/Q295L/A330M/I332E, its binding to FcγRIIa type H was enhanced by 20 times, its binding to FcγRIIa type R was enhanced by 44 times, and its binding to FcγRIIIa F was enhanced by 1114 times as compared to GpH7-Kn033/GpH7-Hl033/GpL16-k0 which is a molecule resulting from the application of the knobs-into-holes technology alone to G1d. This result also shows that, for both H and R types, the FcγRIIa-binding activity was equivalent to that of the homodimerized antibody GpH7-Kn037/GpH7-Hl036/GpL16-k0 in which both of the H chains were introduced with G236A/S239D/I332E of the prior art technology. The FcγRIIIa F-binding activity was increased as compared to the homodimerized antibody GpH7-Kn032/GpH7-Hl032/GpL16-k0 in which both of the H chains were introduced with S239D/A330L/I332E of the prior art technology. The result shown in Table 38 demonstrates that the A/I ratio of GpH7-Kn056/GpH7-Hl055/GpL16-k0 was 8.7 for FcγRIIa type H and 16 for FcγRIIa type R, which was increased as compared to GpH7-Kn033/GpH7-Hl033/GpL16-k0 and GpH7-Kn032/GpH7-Hl032/GpL16-k0; and as compared to GpH7-Kn037/GpH7-Hl036/GpL16-k0, it was almost equivalent for FcγRIIa type H and increased for FcγRIIa type R. The result demonstrates that, using the heterodimerized antibody technology, in GpH7-Kn056/GpH7-Hl055/GpL16-k0, the FcγRIIIa-binding activity is further increased while its FcγRIIa-binding activity is increased to a comparable extent, and the antibody binds more selectively to activating FcγR, as compared to when using the conventional technology.

[Example 13] Comparison with Conventional Technology: Assessment of Thermal Stability of Heterodimerized Antibodies with Increased FcγRIIa- and FcγRIIIa-Binding Activity As described in Example 9, homodimerized antibodies obtained by the conventional technology, though having increased FcγR-binding activity, are physicochemically unstable, and this has reduced their value as pharmaceuticals. On the other hand, it was revealed that the heterodimerized antibody technology was convenient for regulating the effect of each alteration to enhance the FcγR-binding activity and the influence from the physicochemical aspect, and that enhancement of FcγR-binding activity without reducing the physicochemical stability was possible. This Example tests whether antibodies with enhanced binding activities to FcγRIIa and FcγRIIIa, which are activating FcγR, similarly do not have reduced physicochemical stability, thermodynamic stability in particular. Each antibody assessed for its FcγR-binding activity in Example 11 was assayed for the Tm of CH2 region according to the method described in Reference Example 5. The result is summarized in Table 39.

TABLE 39

| Sample | Knob | MUTATION SITE | Hole | MUTATION SITE | Tm (° C.) |
|---|---|---|---|---|---|
| GpH7-Kn033/ GpH7-Hl033/ GpL16-k0 (SEQ ID NO: 51, 56, 5) | Kn033 | — | Hl033 | — | 67.6 |
| GpH7-Kn037/ GpH7-Hl036/ GpL16-k0 (SEQ ID NO: 52, 57, 5) | Kn037 | G236A/ S239D/ I332E | Hl036 | G236A/ S239D/ I332E | |
| GpH7-Kn032/ GpH7-Hl032/ GpL16-k0 (SEQ ID NO: 53, 58, 5) | Kn032 | S239D/ A330L/ I332E | Hl032 | S239D/ A330L/ I332E | 48.9 |
| GpH7-Kn045/ GpH7-Hl048/ GpL16-k0 (SEQ ID NO: 54, 59, 5) | Kn045 | L234Y/ L235Y/ G236A/ H268D/ S298A | Hl048 | G236A/ S239D/ A330K/ I332E | 60.9 |
| GpH7-Kn045/ GpH7-Hl055/ GpL16-k0 (SEQ ID NO: 54, 60, 5) | Kn045 | L234Y/ L235Y/ G236A/ H268D/ S298A | Hl055 | G236A/ S239D/ Q295L/ A330M/ I332E | 60.4 |
| GpH7-Kn056/ GpH7-Hl055/ GpL16-k0 (SEQ ID NO: 55, 60, 5) | Kn056 | L234Y/ L235Y/ G236A/ H268D/ Q295L/ S298A | Hl055 | G236A/ S239D/ Q295L/ A330M/ I332E | 60.4 |

The table shows Tm of antibodies with increased binding activities to FcγRIIa and FcγRIIIa.

The result shown in Table 39 demonstrates that all of heterodimerized antibodies GpH7-Kn045/GpH7-Hl048/GpL16-k0, GpH7-Kn045/GpH7-Hl055/GpL16-k0, and GpH7-Kn056/GpH7-Hl055/GpL16-k0 retained high Tm as compared to the homodimerized antibodies GpH7-Kn037/GpH7-Hl036/GpL16-k0 and GpH7-Kn032/GpH7-Hl032/GpL16-k0 of the prior art. As described in Example 11, the heterodimerized antibodies have properties more suitable to achieve FcγR-mediated effector function as compared to the conventional homodimerized antibodies. Specifically, the finding described above demonstrates that the binding to FcγR can be finely regulated without reducing the physicochemical stability of antibodies by using the heterodimerized antibody technology.

[Example 14] Effect of a Combination of Alterations that Improve the Selectivity for FcγRIIIa F, an Activating FcγR As described in Example 8, technologies for improving the selectivity for activating FcγR and inhibitory FcγR are useful. This Example tests whether the heterodimerization is effective to increase the ratio between the binding to FcγRIIIa F, an activating Fcγ, and the binding to FcγRIIb, an inhibitory FcγR, i.e., effective to improve the selectivity, as described in Example 8. Specifically, L234Y, G236W, and S298A (Region a shown in Table 22-1), which are alterations that increase the ratio between the binding to FcγRIIIa F, an activating Fcγ, and the binding to FcγRIIb, an inhibitory FcγR, were combined with S239D, A330L, and I332E assessed in Example 7, to test whether improvement in selectivity can be achieved in heterodimerized antibodies as compared to homodimerized antibodies.

To assess this, expression vectors inserted with GpH7-A57 (SEQ ID NO: 40) resulting from introduction of all S239D, A330L, and I332E into GpH7-A5; GpH7-B78 (SEQ ID NO: 41) resulting from introduction of all S239D, A330L, and I332E into GpH7-B3; GpH7-TA7 (SEQ ID NO: 31) resulting from introduction of all L234Y, G236W, and S298A into GpH7-A5; and GpH7-TA45 (SEQ ID NO: 32) resulting from introduction of all L234Y, G236W, and S298A into GpH7-B3 were constructed according to the method described in Reference Example 1. Using these expression vectors and GpH7-A5, GpH7-B3, and GpL16-k0, hetero GpH7-TA7/GpH7-B78/GpL16-k0 one of whose H chains had been introduced with L234Y, G236W, and S298A and the other had been introduced with S239D, A330L, and I332E;
GpH7-TA7/GpH7-B3/GpL16-k0 only one of whose H chains had been introduced with L234Y, G236W, and S298A;
GpH7-TA7/GpH7-TA45/GpL16-k0 both of whose H chains had been introduced with L234Y, G236W, and S298A;
GpH7-A5/GpH7-B78/GpL16-k0 only one of whose H chains had been introduced with S239D, A330L, and I332E; and
GpH7-A57/GpH7-B78/GpL16-k0 both of whose H chains had been introduced with S239D, A330L, and I332E
were expressed and prepared according to the method described in Reference Example 1. The prepared antibodies were assayed as to the KDs for FcγRIIIa and FcγRIIb according to the method described in Reference Example 2. Whether each antibody was improved for the FcγRIIIa-binding activity selectivity was assessed using, as an indicator, FcγRIIIa/FcγRIIb ratio that is obtained by dividing KD of each antibody for FcγRIIb by KD of each antibody for FcγRIIIa. The assessment result is summarized in Table 40.

TABLE 40

| SAMPLE | H1 | MUTATION SITE | H2 | MUTATION SITE | FcγRIIIa F KD (M) | FcγRIIb KD (M) | FcγRIIIa F/ FcγRIIb ratio |
|---|---|---|---|---|---|---|---|
| GpH7-G1d/GpL16-k0 (SEQ ID NO: 2, 5) | G1d | | G1d | | 1.2E−06 | 3.1E−06 | 2.5 |
| GpH7-A5/GpH7-B3/ GpL16-k0 (SEQ ID NO: 3, 4, 5) | A5 | — | B3 | — | 1.6E−06 | 3.1E−06 | 1.9 |

TABLE 40-continued

| SAMPLE | H1 | MUTATION SITE | | | H2 | MUTATION SITE | | | FcγRIIIa F KD (M) | FcγRIIb KD (M) | FcγRIIIa F/ FcγRIIb ratio |
|---|---|---|---|---|---|---|---|---|---|---|---|
| GpH7-TA7/GpH7-B3/ GpL16-k0 (SEQ ID NO: 31, 4, 5) | TA7 | L234Y | G236W | S298A | B3 | — | — | — | 3.2E−07 | 4.5E−06 | 14 |
| GpH7-A5/GpH7-B78/ GpL16-k0 (SEQ ID NO: 3, 41, 5) | A5 | — | — | — | B78 | S239D | A330L | I332E | 5.4E−08 | 4.3E−07 | 7.9 |
| GpH7-A57/GpH7-B78/ GpL16-k0 (SEQ ID NO: 40, 41, 5) | A57 | S239D | A330L | I332E | B78 | S239D | A330L | I332E | 6.2E−09 | 6.1E−07 | 100 |
| GpH7-TA7/GpH7-TA45/ GpL16-k0 (SEQ ID NO: 31, 32, 5) | TA7 | L234Y | G236W | S298A | TA45 | L235Y | G237W | S299A | 3.3E−06 | 1.8E−05 | 5.3 |
| GpH7-TA7/GpH7-B78/ GpL16-k0 (SEQ ID NO: 31, 41, 5) | TA7 | L234Y | G236W | S298A | B78 | S239D | A330L | I332E | 4.7E−09 | 1.1E−06 | 244 |

The column "SAMPLE" indicates antibody names; the columns "H1" and "H2" indicate names of the H chain constant region in each antibody; and the column "MUTATION SITE" indicates mutations that are different in comparison with GpH7-A5/GpH7-B3/GpL16-k0 ("-": used when there is no particular mutation). Values obtained by dividing the KD of each antibody for FcγRIIb by the KD of each antibody for FcγRIIIa F are indicated under "FcγRIIIa F/FcγRIIb ratio". The SEQ ID NOs are also shown for the amino acid sequences of the H chain and L chain of each antibody.

When, based on the results shown in Table 40, a native IgG1 GpH7-G1d/GpL16-k0 is compared to GpH7-A5/GpH7-B3/GpL16-k0 in which D356K, H435R, and K439E each have been introduced into one H chain, the FcγRIIIa/FcγRIIb ratio is 2.5 and 1.9, respectively, and there was no great difference between them. This suggests that alterations D356K, H435R, and K439E do not affect the selectivity of the binding activity to FcγRIIIa.

The effect of each alteration on homodimerized antibodies of prior-art technique was verified. The FcγRIIIa/FcγRIIb ratio of homodimerized antibody GpH7-A57/GpH7-B78/GpL16-k0 both of whose H chains had been introduced with S239D, A330L, and I332E was 100, and was increased as compared to GpH7-A5/GpH7-B3/GpL16-k0. Meanwhile, the FcγRIIIa/FcγRIIb ratio of homodimerized antibody GpH7-TA7/GpH7-TA45/GpL16-k0 both of whose H chains had been introduced with L234Y, G236W, and S298A was 5.3. Regarding homodimerized antibodies, the combination of S239D, A330L, and I332E was demonstrated to have the greater effect to improve the selectivity of the binding activity to FcγRIIIa.

Next, heterodimerized antibodies only one of whose H chains had been introduced with each alteration group were assessed for the effect of each alteration group. The FcγRIIIa/FcγRIIb ratio of heterodimerized antibody GpH7-A5/GpH7-B78/GpL16-k0 one of whose H chain had been introduced with S239D, A330L, and I332E was 7.9, and was increased as compared to GpH7-A5/GpH7-B3/GpL16-k0. Meanwhile, the FcγRIIIa/FcγRIIb ratio of heterodimerized antibody GpH7-TA7/GpH7-B3/GpL16-k0 one of whose H chain had been introduced with L234Y, G236W, and S298A was 14. These results demonstrate that, regarding heterodimerized antibodies, the group of alterations L234Y, G236W, and S298A has the greater effect to increase the selectivity of the binding activity to FcγRIIIa.

The difference in the effect of each alteration group in homodimerized antibodies and heterodimerized antibodies was assessed. Regarding S239D, A330L, and I332E, the FcγRIIIa/FcγRIIb ratio of the heterodimerized antibody with them was 7.9 while that of the homodimerized antibody with them was 100. These results demonstrate that S239D, A330L, and I332E have the effect to improve the selectivity of the binding activity to FcγRIIIa upon heterodimerization, and the effect is further enhanced upon homodimerization. On the other hand, regarding L234Y, G236A, and S298A, the FcγRIIIa/FcγRIIb ratio of the heterodimerized antibody with them was 14, while that of the homodimerized antibody with them was 5.3. These results demonstrate that L234Y, G236A, and S298A have the effect to improve the selectivity of the binding activity to FcγRIIIa upon heterodimerization, but the effect is reduced upon homodimerization. The results demonstrate that the group of alterations S239D, A330L, and I332E in homodimerized antibodies has the greater effect to improve the selectivity of the binding activity to FcγRIIIa than the group of alterations L234Y, G236A, and S298A, while the group of alterations L234Y, G236A, and S298A in heterodimerized antibodies has the greater effect to improve the selectivity of the binding activity to FcγRIIIa than the group of alterations S239D, A330L, and I332E.

It was demonstrated that The FcγRIIIa/FcγRIIb ratio of heterodimerized antibody GpH7-TA7/GpH7-B78/GpL16-k0 with the group of alterations L234Y, G236A, and S298A in combination with the group of alterations S239D, A330L, and I332E was 244, and thus its effect to improve the selectivity of the binding activity to FcγRIIIa was higher as compared to heterodimerized antibody GpH7-TA7/GpH7-B3/GpL16-k0 only one of whose H chains had the group of alterations L234Y, G236A, and S298A, homodimerized antibody GpH7-TA7/GpH7-TA45/GpL16-k0 both of whose H chains has the group of alterations L234Y, G236A, and S298A, heterodimerized antibody GpH7-A5/GpH7-B78/GpL16-k0 only one of whose H chains has the group of alterations S239D, A330L, and I332E, and homodimerized antibody GpH7-A57/GpH7-B78/GpL16-k0 both of whose H chains have the group of alterations S239D, A330L, and I332E. These results are thought to be a sum of the effect of the group of alterations L234Y, G236A, and S298A in a heterodimerized antibody to improve the selectivity of the binding activity to FcγRIIIa and the effect of the group of alterations S239D, A330L, and I332E in a heterodimerized antibody. Specifically, it was revealed that heterodimerized antibodies show excellent effect in improving the selectivity of the binding activity to FcγRIIIa as compared to homodimerized antibodies.

Specifically, it was shown that the use of heterodimerized antibodies, instead of conventional homodimerized antibodies, enables finer optimization of the asymmetric interaction between Fc region and FcγRIIIa and design Fc regions having greater selectivity of the binding activity to FcγRIIIa.

[Example 15] Measurement of ADCC Activity of Heterodimerized Antibodies that Exhibit Enhanced FcgRIIa Binding The ADCC activity of GpH7-G1d/GpL16-k0, GpH7-Kn033/GpH7-Hl033/GpL16-k0, GpH7-Kn037/GpH7-Hl036/GpL16-k0, GpH7-Kn032/GpH7-Hl032/GpL16-k0, GpH7-Kn045/GpH7-Hl048/GpL16-k0, and GpH7-Kn056/GpH7-Hl055/GpL16-k0 prepared in Example 12 was evaluated according to the method described in Reference Example 7. The results are summarized in FIG. 33.

When GpH7-G1d/GpL16-k0 and GpH7-Kn033/GpH7-Hl033/GpL16-k0 were compared for ADCC activity based on FIG. 33, they had comparable ADCC activity. This result demonstrates that knobs-into-holes, even when introduced into an antibody Fc region, does not affect the FcγR binding or ADCC activity.

Both heterodimerized antibodies GpH7-Kn045/GpH7-Hl048/GpL16-k0 and GpH7-Kn056/GpH7-Hl055/GpL16-k0 described in Example 12 exhibited greater ADCC activity as compared to antibody GpH7-Kn033/GpH7-Hl033/GpL16-k0 before introduction of alteration. Meanwhile, heterodimerized antibodies GpH7-Kn045/GpH7-Hl048/GpL16-k0 and GpH7-Kn056/GpH7-Hl055/GpL16-k0 showed ADCC activity comparable to that of homodimerized antibody GpH7-Kn037/GpH7-Hl036/GpL16-k0 both of whose H chains have the alteration G236A/S239D/I332E which had been reported to enhance the FcgRIIa R and FcgRIIa H binding and ADCP activity and to that of antibody GpH7-Kn032/GpH7-Hl032/GpL16-k0 resulting from application of existing ADCC activity enhancement.

Specifically, as shown in Example 12, GpH7-Kn045/GpH7-Hl048/GpL16-k0 and GpH7-Kn056/GpH7-Hl055/GpL16-k0 not only exhibit further enhanced binding to FcgRIIa R and FcgRIIa H as compared to the existing technique but also have ADCC activity-enhancing effect comparable to the existing ADCC activity-enhancing technique. Specifically, heterodimerized antibodies assessed herein are superior to the existing technique in that not only they have the ADCC activity-enhancing effect comparable to that achieved by the existing technique but also exhibit enhanced binding to FcgRIIa H and FcgRIIa R.

[Example 16] Preparation of Heterodimerized Antibody H240-Kn061/H240-Hl071/L73-k0 that Exhibits Enhanced FcgRIIIa Binding As described in Example 11, heterodimerized antibodies with increased FcγRIIIa-binding activity were demonstrated to have improved ADCC activity. In Example 11, the effect was demonstrated with antibodies against GPC3. Whether the same effect can be observed for other antigens was assessed by conducting a similar experiment using an anti-epiregulin (EREG) antibody. Herein, the H chain variable region sequence of the antibody against EREG is referred to as H240 (SEQ ID NO: 80), and its L chain sequence including the variable and constant regions is referred to as L73-k0 (SEQ ID NO: 106).

Based on the results of Example 4, new variants having H chains which exhibit enhanced FcgRIIIa binding were prepared. Herein, the knobs-into-holes technique described in Example 12 was used as the heterodimerization technique. Specifically, H240-Kn033 (SEQ ID NO: 84) resulting from introduction of alterations Y349C and T366W into the constant region of H240-G1d (SEQ ID NO: 83) and H240-Hl033 (SEQ ID NO: 85) resulting from introduction of alterations D356C, T366S, L368A, and Y407V into the constant region of H240-G1d were prepared according to the method described in Reference Example 1. Then, H240-Kn061 (SEQ ID NO: 81) was prepared by introducing L234Y, L235Y, G236W, H268D, and S298A into H240-Kn033 (SEQ ID NO: 84) according to the method described in Reference Example 1. H240-Hl071 (SEQ ID NO: 82) was constructed by introducing K326D, A330M, and K334E into H240-Hl033 (SEQ ID NO: 85) according to the method described in Reference Example 1. Heterodimerized antibody H240-Kn061/H240-Hl071/L73-k0 was expressed by combining H240-Kn061, H240-Hl071, and L73-k0 according to the method described in Reference Example 1.

Variants introduced with S239D, A330L, and I332E, which have been reported to enhance the binding to FcγRIIIa, were constructed in the same manner as described in Example 12, to be used for comparison. Specifically, H240-Kn032 (SEQ ID NO: 86) and H240-Hl032 (SEQ ID NO: 87), resulting from introduction of S239D, A330L, and I332E into H240-Kn033 (SEQ ID NO: 84) and H240-Hl033 (SEQ ID NO: 85), respectively, were prepared according to the method described in Reference Example 1. Homodimerized antibody H240-Kn032/H240-Hl032/L73-k0 was expressed by combining H240-Kn032, H240-Hl032, and L73-k0 according to the method described in Reference Example 1.

Then, an afucosylated antibody, which has been reported to enhance the binding to FcgRIIIa (Glycobiol. Vol. 17 no. 1 pp. 104-118 (2006)), was prepared for comparison. The fucose transporter function is inhibited in cells where the expression of the fucose transporter gene has been artificially suppressed on both homologous chromosomes. Antibodies lacking fucose can be obtained by using such cells (WO 2006/067913, etc.). Alternatively, antibodies lacking fucose can also be obtained by producing antibodies in cells with forced expression of beta 1,4-N-acetylglucosaminyltransferase III and Golgi alpha-mannosidase II (Ferrara et al., Biotechnol. Bioeng. (2006) 93 (5), 851-861). H240-G1d (SEQ ID NO: 83) and L73-k0 (SEQ ID NO: 106) were expressed in combination, and antibody H240-afucosyl_G1d/L73-k0 (SEQ ID NOs: 83 and 106) was obtained by afucosylating H240-G1d/L73-k0 using the above-described technologies known to those skilled in the art.

Furthermore, H240-Kn033/H240-Hl033/L73-k0 was expressed as a control by combining H240-Kn033 (SEQ ID NO: 84), H240-Hl033 (SEQ ID NO: 85), and L73-k0 (SEQ ID NO: 106) according to the method described in Reference Example 1.

The binding activity of the antibodies to each FcgR was evaluated according to the method described in Reference Example 8 and the results are summarized in Table 41.

TABLE 41

| Sample | FcgRIa KD (M) | FcgRIIa R KD (M) | FcgRIIa H KD (M) | FcgRIIb KD (M) | FcgRIIIa F KD (M) | FcgRIIIa V KD (M) |
|---|---|---|---|---|---|---|
| H240-G1d/L73-k0 | 2.3E−10 | 8.8E−07 | 6.6E−07 | 6.0E−06 | 1.4E−06 | 3.1E−07 |
| H240-Kn033/H240-Hl033/L73-k0 | 2.5E−10 | 1.0E−06 | 9.3E−07 | 4.1E−06 | 2.6E−06 | 3.9E−07 |
| H240-Kn032/H240-Hl032/L73-k0 | 7.3E−11 | 3.4E−07 | 6.9E−07 | 6.2E−07 | 9.1E−09 | 3.1E−09 |
| H240-afucosyl_G1d/L73-k0 | 4.3E−10 | 4.9E−07 | 7.8E−07 | 2.6E−06 | 7.8E−08 | 6.9E−09 |
| H240-Kn061/H240-Hl071/L73-k0 | 1.4E−10 | 3.5E−07 | 2.8E−07 | 1.2E−06 | 5.1E−09 | 1.8E−09 |

The results shown in Table 41 demonstrate that the binding of heterodimerized antibody H240-Kn061/H240-Hl071/L73-k0, in particular, to FcgRIIIa F and FcgRIIIa V was enhanced as compared to H240-Kn033/H240-Hl033/L73-k0. Since heterodimerized antibody H240-Kn061/H240-Hl071/L73-k0 is a variant resulting from introduction of L234Y/L235Y/G236W/H268D/S298A and K326D/A330M/K334E into H240-Kn033/H240-Hl033/L73-k0, it can be said that the binding of the introduced alterations to FcgR was enhanced.

The results shown in Table 41 demonstrate that the FcgRIIIa F and FcgRIIIa V binding of heterodimerized antibody H240-Kn061/H240-Hl071/L73-k0 was enhanced as compared to H240-afucosyl_G1d/L73-k0 and H240-Kn032/H240-Hl032/L73-k0 resulting from application of the existing ADCC activity-enhancing technique. This result demonstrates that the heterodimerized antibody exhibits the strong effect to enhance the binding to FcgRIIIa as compared to the conventional homodimerized antibody-based ADCC activity-enhancing technique and the afucosylation-based ADCC activity-enhancing technique.

In addition, regarding the FcgRIIa binding that is thought to be important for ADCP activity enhancement, the FcgRIIa H-binding of the heterodimerized antibody was enhanced compared to the two antibodies, and its FcgRIIa R binding was enhanced relative to H240-afucosyl_G1d/L73-k0 and comparable to that of H240-Kn032/H240-Hl032/L73-k0.

Whether heterodimerized antibody H240-Kn061/H240-Hl071/L73-k0 has the feature of a heterodimerized antibody, which is that it has enhanced FcgR-binding activity compared to homodimerized antibodies comprising each H chain therefrom, was assessed. In the heterodimerized antibody H240-Kn061/H240-Hl071/L73-k0, L234Y/L235Y/G236W/H268D/S298A has been introduced into H240-Kn061, which is one of the H chains, and K326D/A330M/K334E has been introduced into H240-Hl071, which is the other H chain. The heterodimerized antibody was compared to homodimerized antibodies comprising each H chain therefrom to assess whether the heterodimerized antibody has stronger binding activity to each FcgR. Specifically, H240-Hl134 (SEQ ID NO: 88) resulting from introduction of L234Y/L235Y/G236W/H268D/S298A into H240-Hl033 and H240-Kn132 (SEQ ID NO: 89) resulting from introduction of K326D/A330M/K334E into H240-Kn033 were constructed according to the method described in Reference Example 1. Using these expression vectors, homodimerized antibody H240-Kn061/H240-Hl134/L73-k0 both of whose H chains have L234Y/L235Y/G236W/H268D/S298A and homodimerized antibody H240-Kn132/H240-Hl071/L73-k0 both of whose H chains have K326D/A330M/K334E were expressed according to the method described in Reference Example 1. The binding to FcgRIIIaF and FcgRIIIa V of homodimerized antibodies and heterodimerized antibody H240-Kn061/H240-Hl071/L73-k0 each of whose H chains has L234Y/L235Y/G236W/H268D/S298A or K326D/A330M/K334E was measured according to the method described in Reference Example 8. The results are summarized in Table 42.

TABLE 42

| Sample | FcgRIIIa F KD (M) | FcgRIIIa V KD (M) |
|---|---|---|
| H240-Kn061/H240-Hl071/L73-k0 | 5.1E−09 | 1.8E−09 |
| H240-Kn061/H240-Hl134/L73-k0 | 6.6E−07 | 8.6E−08 |
| H240-Kn132/H240-Hl071/L73-k0 | 7.7E−08 | 1.6E−08 |

The results shown in Table 42 demonstrate that the FcgRIIIa F- and FcgRIIIa V-binding activity of heterodimerized antibody H240-Kn061/H240-Hl071/L73-k0 one of whose H chains has L234Y/L235Y/G236W/H268D/S298A and the other H chain has K326D/A330M/K334E is stronger than the activity of homodimerized antibody H240-Kn061/H240-Hl134/L73-k0 both of whose H chains have L234Y/L235Y/G236W/H268D/S298A and homodimerized antibody H240-Kn132/H240-Hl071/L73-k0 both of whose H chains have K326D/A330M/K334E. Namely, H240-Kn061/H240-Hl071/L73-k0 was demonstrated to have the feature of a heterodimerized antibody, which is that it has enhanced FcgR-binding activity compared to homodimerized antibodies comprising each H chain therefrom.

Next, the ADCC activities of H240-Kn033/H240-Hl033/L73-k0, H240-Kn032/H240-Hl032/L73-k0, H240-afucosyl_G1d/L73-k0, and H240-Kn061/H240-Hl071/L73-k0 were compared according to the method described in Reference Example 9. The results are summarized in FIG. 34.

The results shown in FIG. 34 demonstrate that H240-Kn061/H240-Hl071/L73-k0 exhibits significantly stronger ADCC activity as compared to H240-Kn033/H240-Hl033/L73-k0. Furthermore, the ADCC activity was stronger than that of H240-Kn032/H240-Hl032/L73-k0 and H240-afucosyl_G1d/L73-k0 resulting from application of the existing ADCC activity-enhancing technique. Namely, H240-Kn061/H240-Hl071/L73-k0 was demonstrated to exhibit stronger ADCC activity than that achieved with the existing ADCC activity-enhancing technique.

[Example 17] Preparation of Further Variants Using Heterodimerized Antibody H240-Kn061/H240-Hl071/L73-k0 as a Template and Assessment Thereof H240-Kn061/H240-Hl071/L73-k0 exhibiting superior ADCC activity was discovered in Example 16 above. To reveal further variants with superior activity, a total of about 420 types of variants in which amino acids at positions 231 to 242 (EU numbering) have been substituted with 18 types of amino acids excluding Cys and original amino acid in each of the H chains of H240-Kn061 and H240-Hl071 were prepared using H240-Kn061/H240-Hl071/L73-k0 as a template according to the method described in Reference Example 1. The antibodies were assessed for the binding to each FcgR. Specifically, the KD value of each variant was calculated for each of FcgRI, FcgRIIa R, FcgRIIa H, FcgRIIb, FcgRIIIa F, and FcgRIIIa V according to the method described in Reference Example 8, and the KD value of H240-Kn061/H240-Hl071/L73-k0 for each of FcgRI, FcgRIIa R, FcgRIIa H, FcgRIIb, FcgRIIIa F, and FcgRIIIa V was divided by the KD value obtained above. The resultant value was defined as relative KD, and used as an assessment indicator. Specifically, the degree of folds changed in the KD value of each variant for each FcgR when taking the KD value of H240-Kn061/H240-Hl071/L73-k0 as 1 was used as an assessment indicator. When the relative KD is larger, it means that the binding of the variant to each FcgR is more strongly enhanced as compared to H240-Kn061/H240-Hl071/L73-k0.

Graphs in which relative KDs of respective variants for FcgRI, FcgRIIa R, FcgRIIa H, FcgRIIb, FcgRIIIa F, or FcgRIIIa V is shown on the vertical axis and rank numbers when arranging relative KDs in ascending order are shown on the horizontal axis are displayed in FIGS. 35, 36, 37, 38, 39, and 40, respectively.

From the analysis result, variants that enhance the binding to any one of, or several of FcgRIIa R, FcgRIIIa F, and FcgRIIIa V without enhancing the FcgRIIb binding relative to H240-Kn061/H240-Hl071/L73-k0 were discovered. Alterations and H chains introduced with the alterations are summarized in Table 43 (alterations that enhance the binding to FcgRIIa R and FcgRIIIa without enhancing the binding to FcgRIIb). Alterations in which the relative KD is 1 or less for FcgRIIb and the relative KD value is 1.3 or more for any one of, or several of FcgRIIa R, FcgRIIIa F, and FcgRIIIa V were selected.

The values shown in Table 43 above indicate the relative KD of each variant for each FcgR.

The alterations have the effect to enhance the binding to FcgRIIa that plays an important role in ADCP activity and the binding to FcgRIIIa that plays an important role in ADCC activity without enhancing the binding to FcgRIIb, an inhibitory FcgR. Thus, a stronger antitumor activity can be expected, since the introduction of these alterations increase ADCC and ADCP activities without enhancing the antibody's immunosuppressive action.

Furthermore, variants that enhance the binding to FcgRIIa H and FcgRIIa R without reducing the FcgRIIIa binding relative to H240-Kn061/H240-Hl071/L73-k0 were discovered. Alterations and H chains introduced with the alterations are summarized in Table 44 (alterations that enhance the binding to FcgRIIa without reducing the binding to FcgRIIIa). Alterations in which the relative KD is 0.7 or more for FcgRIIIa F and FcgRIIIa V and the relative KD is 1.5 or more for FcgRIIa H and FcgRIIa R were selected.

TABLE 44

| ALTERATION-INTRODUCED H CHAIN | ALTERATION | FcgRIIa R | FcgRIIa H | FcgRIIb | FcgRIIIa F | FcgRIIIa V |
|---|---|---|---|---|---|---|
| H240-Kn061 | A231E | 1.7 | 1.6 | 1.4 | 1.8 | 2 |
| H240-Kn061 | A231V | 1.6 | 1.6 | 1.6 | 1.3 | 1.5 |
| H240-Kn061 | A231Q | 1.5 | 1.5 | 1.4 | 1.5 | 1.7 |
| H240-Kn061 | Y234L | 2.2 | 1.5 | 3.5 | 1.1 | 1.2 |
| H240-Kn061 | Y234I | 4.1 | 2.6 | 7.7 | 1.2 | 1.3 |
| H240-Kn061 | S239M | 3.2 | 2 | 2.2 | 2.2 | 2.8 |
| H240-Kn061 | S239I | 4.4 | 2.1 | 3.1 | 3 | 3.4 |
| H240-Kn061 | S239L | 4.8 | 2.4 | 3.4 | 3.4 | 3.7 |
| H240-Kn061 | S239V | 4.2 | 2.4 | 3.4 | 2.4 | 2.9 |
| H240-Hl071 | F241N | 3.8 | 3.5 | 1.1 | 0.8 | 0.7 |

The values shown in Table 44 above indicate the relative KD of each variant for each FcgR.

The alterations enhance the binding to FcgRIIa that plays an important role in ADCP activity without reducing the binding to FcgRIIIa that plays an important role in ADCC activity, and some of the alterations enhance the binding to FcgRIIIa. Thus, a stronger antitumor activity can be expected by introducing the alterations and thus increasing ADCC and ADCP activities, or either ADCC or ADCP activity.

Furthermore, variants that reduce the binding to FcgRIIb without reducing the binding to FcgRIIIa relative to H240-Kn061/H240-Hl071/L73-k0 were discovered. Alterations and H chains introduced with the alterations are summarized in Table 45 (alterations that reduce the binding to FcgRIIb while maintaining the binding to FcgRIIIa). Alterations in which the relative KD is 1 or more for FcgRIIIa F and FcgRIIIa V and the relative KD is 0.5 or less for FcgRIIb were selected.

TABLE 43

| ALTERATION-INTRODUCED H CHAIN | ALTERATION | FcgRIIa R | FcgRIIa H | FcgRIIb | FcgRIIIa F | FcgRIIIa V |
|---|---|---|---|---|---|---|
| H240-Hl071 | L235F | 1.2 | 1.1 | 1 | 1.9 | 1.6 |
| H240-Hl071 | V240A | 1 | 1.2 | 1 | 1.3 | 1.7 |
| H240-Hl071 | V240F | 1.1 | 0.9 | 0.9 | 1.4 | 1 |
| H240-Hl071 | F241L | 1.2 | 1.2 | 0.8 | 1.3 | 1.3 |
| H240-Hl071 | F241M | 1.3 | 1.1 | 0.9 | 1.3 | 1.3 |
| H240-Kn061 | Y234E | 1.4 | 0.7 | 0.5 | 1.9 | 1.6 |
| H240-Kn061 | Y235N | 1 | 0.7 | 0.7 | 1.3 | 2 |

TABLE 45

| ALTERATION-INTRODUCED H CHAIN | ALTERATION | FcgRIIa R | FcgRIIa H | FcgRIIb | FcgRIIIa F | FcgRIIIa V |
|---|---|---|---|---|---|---|
| H240-Hl071 | V240H | 0.7 | 0.8 | 0.3 | 1.3 | 1 |
| H240-Kn061 | Y234E | 1.4 | 0.7 | 0.5 | 1.9 | 1.6 |
| H240-Kn061 | Y235A | 0.5 | 0.5 | 0.2 | 1.2 | 1.3 |
| H240-Kn061 | Y235I | 0.7 | 0.4 | 0.2 | 1.3 | 1.6 |
| H240-Kn061 | Y235P | 0.6 | 0.4 | 0.5 | 1.1 | 1.5 |
| H240-Kn061 | Y235Q | 0.8 | 0.4 | 0.1 | 1 | 1.3 |
| H240-Kn061 | Y235V | 0.5 | 0.4 | 0.2 | 1.2 | 1.3 |

The values shown in Table 45 above indicate the relative KD of each variant for each FcgR.

The alterations reduce the binding to FcgRIIb, an inhibitory FcgR, without reducing the binding to FcgRIIIa that plays an important role in ADCC activity. Thus, a stronger antitumor activity can be expected, since introduction of the alterations reduce the antibody's immunosuppressive action without reducing ADCC activity.

Furthermore, since heterodimerized antibody H240-Kn061/H240-Hl071/L73-k0 has the feature of a heterodimerized antibody which is that it binds more strongly to FcgR than homodimerized antibodies comprising each H chain therefrom, variants obtained by introducing the alterations into H240-Kn061/H240-Hl071/L73-k0 are thought to have the same feature of a heterodimerized antibody.

[Example 18] Alterations that can Substitute the Alterations Introduced into the Heterodimerized Antibody H240-Kn061/H240-Hl071/L73-k0

Based on the results shown in FIGS. 35, 36, 37, 38, 39, and 40 obtained in Example 17, whether the alterations in the heterodimerized antibody H240-Kn061/H240-Hl071/L73-k0 were substitutable with other alterations was assessed. Herein, "substitutable alteration" refers to an alteration, when introduced, results in the binding to FcgRIIIa F and FcgRIIIa V of 0.7 times or more, and the binding to FcgRIIb of 1.3 times or less as compared to before introduction of the alteration.

Regarding the variants prepared in Example 17, alterations were introduced into antibodies at amino acid positions 231 to 242 (EU numbering). In the heterodimerized antibody H240-Kn061/H240-Hl071/L73-k0, L234Y/L235Y/G236W/H268D/S298A has been introduced into H chain H240-Kn061 and K326D/A330M/K334E has been introduced into H chain H240-Hl071. Of the alterations introduced into H chain H240-Kn061, whether L234Y, L235Y, and G236W are substitutable with other amino acids can be assessed based on the results shown in Example 17.

The alteration sites include positions 234, 235, and 236 (EU numbering) in H chain H240-Kn061, which is one of the H chains of H240-Kn061/H240-Hl071/L73-k0, but do not include the alteration sites introduced into H chain H240-Hl071, which is the other H chain. Of the variants prepared in this experiment, those introduced with alterations at positions 234, 235, and 236 (EU numbering) in H chain H240-Kn061, those having a binding to FcgRIIIa F and FcgRIIIa V is 0.7 times or more and a binding to FcgRIIb is 1.3 times or less as compared to H240-Kn061/H240-Hl071/L73-k0 are thought to have a comparable or superior activity to H240-Kn061/H240-Hl071/L73-k0. Thus, substitutions without reducing the excellent properties of heterodimerized antibody H240-Kn061/H240-Hl071/L73-k0 were thought to be possible. Regarding alterations that meet the conditions described above, the alterations and H chains introduced with them are summarized in Table 46 (alterations that allow retaining the activity comparable or that confer the activity superior to that of H240-Kn061/H240-Hl071/L73-k0).

TABLE 46

| ALTERATION-INTRODUCED H CHAIN | ALTERATION | FcgRIIb | FcgRIIIa F | FcgRIIIa V |
|---|---|---|---|---|
| H240-Kn061 | Y234A | 1.2 | 0.8 | 0.9 |
| H240-Kn061 | Y234E | 0.5 | 1.9 | 1.6 |
| H240-Kn061 | Y234G | 0.9 | 0.8 | 0.9 |
| H240-Kn061 | Y234H | 1.3 | 0.8 | 0.9 |
| H240-Kn061 | Y234S | 1.0 | 0.9 | 0.9 |
| H240-Kn061 | Y235A | 0.2 | 1.2 | 1.3 |
| H240-Kn061 | Y235E | 0.8 | 2.2 | 3.2 |
| H240-Kn061 | Y235F | 1.2 | 1.3 | 1.5 |
| H240-Kn061 | Y235I | 0.2 | 1.3 | 1.6 |
| H240-Kn061 | Y235L | 0.9 | 1.8 | 1.5 |
| H240-Kn061 | Y235M | 0.7 | 1.7 | 1.8 |
| H240-Kn061 | Y235N | 0.7 | 1.3 | 2.0 |
| H240-Kn061 | Y235P | 0.5 | 1.1 | 1.5 |
| H240-Kn061 | Y235Q | 0.1 | 1.0 | 1.3 |
| H240-Kn061 | Y235T | 0.6 | 0.9 | 1.1 |
| H240-Kn061 | Y235V | 0.2 | 1.2 | 1.3 |
| H240-Kn061 | Y235W | 1.3 | 1.1 | 1.3 |
| H240-Kn061 | W236Y | 0.8 | 0.8 | 1.2 |

In Table 46 shown above, "ALTERATION-INTRODUCED H CHAIN" means to which H chain of H240-Kn061/H240-Hl071/L73-k0 is it substitutable; and in "ALTERATION", a numeral represents a residue number according to EU numbering, the first alphabetical letter represents an amino acid corresponding to an indicated residue number in H240-Kn061/H240-Hl071/L73-k0, and the last alphabetical letter represents a substitutable amino acid.

From the results, among the alterations introduced into the H chain constant region of H240-Kn061, substitutable sites and amino acids are summarized as shown in Table 47 (alteration sites in H240-Kn061, at which an alteration can be substituted while retaining the activity comparable to that of H240-Kn061/H240-Hl071/L73-k0, and substitutable amino acids).

TABLE 47

| ALTERED POSITION | SUBSTITUTABLE AMINO ACID |
|---|---|
| POSITION 234 | Y, A, E, G, H, S |
| POSITION 235 | Y, A, E, F, I, L, M, N, P, Q, T, V, W |
| POSITION 236 | W, Y |

In Table 47 shown above, "ALTERED POSITION" refers to a residue number according to EU numbering in H240-Kn061; and "SUBSTITUTABLE AMINO ACID" refers to an amino acid, even when substituted at that site with an amino acid shown in this table, allows having the activity comparable to that of H240-Kn061/H240-Hl071/L73-k0, i.e., an amino acid that can be substituted.

Of the alterations introduced into H240-Kn061/H240-Hl071/L73-k0, regarding H268D and S298A of H240-Kn061, and K326D, A330M, and K334E of H240-Hl071, alterations have not been introduced at the corresponding sites in the experiment described in Example 17. Thus, the presence or absence of substitutable alterations at the sites described above is also discussed below based on the results shown in Example 4. Specifically, based on the results shown in Example 4, three alterations, which resulted in an He/Con_3 aF value of 130 or more and which exhibited the strongest effect at the sites, i.e., those that showed a 1.3 fold or more increase as compared to before introduction of alteration in He/Con_3 aF as an indicator for the binding to FcgRIIIa F in a heterodimerized antibody only one of whose H chains had been introduced with an alteration, were selected. The results are summarized in Table 48 (alteration sites of alterations substitutable with the alteration H268D, S298A, K326D, A330M, or K334E of H240-Kn061/H240-Hl071/L73-k0; substitutable amino acids; and resulting FcgRIIIa F-binding activity).

TABLE 48

| ALTERED POSITION | SUBSTITUTABLE AMINO ACID | He/Con_3aF |
|---|---|---|
| 268 | D | 195 |
| 268 | E | 184 |
| 268 | A | 121 |
| 298 | A | 151 |
| 326 | T | 140 |
| 326 | D | 148 |
| 326 | I | 153 |
| 330 | P | 152 |
| 330 | M | 139 |
| 330 | F | 144 |
| 334 | I | 156 |
| 334 | E | 186 |
| 334 | D | 164 |

In Table 48 shown above, "ALTERED POSITION" refers to a residue number according to EU numbering. "SUBSTITUTABLE AMINO ACID" refers to the three alterations which results in a 1.3 fold or more increase as compared to before introduction of alteration in He/Con_3 aF as an indicator for the binding to FcgRIIIa F binding, in a heterodimerized antibody in which an alteration had been introduced into only one H chain as described in Example 4, and which exhibits the strongest effect at the sites. "He/Con_3 aF" is a value defined in Example 4.

Based on the results shown in Table 48, substitutable amino acids at each alteration site are summarized in Table 49 (substitutable alteration sites of alteration H268D, S298A, K326D, A330M, or K334E in H240-Kn061/H240-Hl071/L73-k0 and substitutable amino acids).

TABLE 49

| ALTERED POSITION | SUBSTITUTABLE AMINO ACID |
|---|---|
| 268 | D, E, A |
| 298 | A |
| 326 | T, D, I |
| 330 | P, M, F |
| 334 | I, E, D |

Based on Table 49, even if D of H268D is substituted with E or A in H240-Kn061/H240-Hl071/L73-k0, comparable activity is thought to be achieved. Likewise, even when D of K326D is T or I, or even when M of A330M is P or F, or even when D of K334D is E or I, comparable activity is thought to be achieved. Meanwhile, as to S298A, no alterations that is thought to achieve a comparable activity could be found.

Furthermore, since heterodimerized antibody H240-Kn061/H240-Hl071/L73-k0 has the feature of a heterodimerized antibody which is that it enhances the binding activity to FcgR than homodimerized antibodies comprising each H chain therefrom, variants obtained by introducing the alterations into H240-Kn061/H240-Hl071/L73-k0 are thought to have the same feature of heterodimerized antibody.

[Example 19] Introduction of D270E into Heterodimerized Antibody H240-Kn061/H240-Hl071/L73-k0 and Assessment Thereof Then, to further improve H240-Kn061/H240-Hl071, the present inventors tried to further enhance the FcgRIIIa binding which is thought to increase ADCC activity and to further reduce the FcgRIIb binding which is thought to reduce the antitumor activity of an antibody via immunosuppressive signals. Specifically, D270E, an alteration found in Example 4, which enhances the FcgRIIIa binding and reduces the FcgRIIb binding, was introduced into both H chains of H240-Kn061/H240-Hl071/L73-k0. The sequences obtained by introducing D270E into H240-Kn061 and H240-Hl071 were named H240-Kn072 (SEQ ID NO: 90) and H240-Hl076 (SEQ ID NO: 91), and were combined with L73-k0 to express and prepare the heterodimerized antibody H240-Kn072/H240-Hl076/L73-k0 according to the method described in Example 1. Along with this antibody, H240-Kn033/H240-Hl033/L73-k0, H240-Kn032/H240-Hl032/L73-k0, H240-afucosyl_G1d/L73-k0, and H240-Kn061/H240-Hl071/L73-k0 were assayed for the binding activity to each FcgR according to the method described in Reference Example 8. The results are summarized in Table 50.

TABLE 50

| Sample | FcgRIa KD (M) | FcgRIIa R KD (M) | FcgRIIa H KD (M) | FcgRIIb KD (M) | FcgRIIIa F KD (M) | FcgRIIIa V KD (M) |
|---|---|---|---|---|---|---|
| H240-Kn033/H240-Hl033/L73-k0 | 2.5E−10 | 1.0E−06 | 9.3E−07 | 4.2E−06 | 2.6E−06 | 3.9E−07 |
| H240-Kn032/H240-Hl032/L73-k0 | 7.3E−11 | 3.4E−07 | 6.9E−07 | 6.3E−07 | 9.1E−09 | 3.1E−09 |
| H240-afucosyl_G1d/L73-k0 | 4.3E−10 | 4.9E−07 | 7.8E−07 | 2.6E−06 | 7.9E−08 | 6.9E−09 |
| H240-Kn061/H240-Hl071/L73-k0 | 1.4E−10 | 3.5E−07 | 2.8E−07 | 1.2E−06 | 5.1E−09 | 1.8E−09 |
| H240-Kn072/H240-Hl076/L73-k0 | 1.0E−10 | 7.1E−07 | 1.3E−07 | 5.7E−06 | 2.6E−09 | 1.0E−09 |

Table 50 shows that, similarly to H240-Kn061/H240-Hl071/L73-k0, H240-Kn072/H240-Hl076/L73-k0 more strongly bound to FcgRIIIa F and FcgRIIIa V than H240-Kn032/H240-Hl032/L73-k0 and H240-afucosyl_G1d/L73-k0 resulting from application of the existing ADCC activity-enhancing technique, and in addition it bound more strongly than H240-Kn061/H240-Hl071/L73-k0. The FcgRIIb binding of H240-Kn072/H240-Hl076/L73-k0 was reduced relative to those of H240-Kn032/H240-Hl032/L73-k0 and H240-afucosyl_G1d/L73-k0 produced by the existing ADCC activity-enhancing technique, and in addition it was reduced relative to that of H240-Kn061/H240-Hl071/L73-k0.

Specifically, since introduction of D270E enhances the FcgRIIIa binding that increases ADCC activity, a stronger ADCC activity is expected, and since the binding to FcgRIIb that transduces immunosuppressive signals is impaired, reduction in the antibody's immunosuppressive action is expected. Thus, H240-Kn072/H240-Hl076/L73-k0 is thought to exhibit antitumor effect that is superior to that of H240-Kn061/H240-Hl071/L73-k0.

Then, the ADCC activity of H240-Kn072/H240-Hl076/L73-k0 was compared to those of H240-Kn061/H240-Hl071/L73-k0, H240-Kn033/H240-Hl033/L73-k0, and H240-afucosyl_G1d/L73-k0. The results are shown in FIG. 41.

The results shown in FIG. 41 demonstrate that H240-Kn072/H240-Hl076/L73-k0 exhibits ADCC activity that is significantly stronger than that of H240-Kn033/H240-Hl033/L73-k0. Furthermore, the ADCC activity of H240-Kn072/H240-Hl076/L73-k0 was stronger than that of afucosylated antibody H240-afucosyl_G1d/L73-k0 resulting from application of the existing ADCC activity-enhancing technique, and was comparable to that of H240-Kn061/H240-Hl071/L73-k0.

These results demonstrate that heterodimerized antibody H240-Kn072/H240-Hl076/L73-k0 not only has ADCC activity stronger than that achieved by the existing ADCC activity-enhancing technique but also exhibits reduced binding to FcgRIIb and thus is a more excellent antibody than those obtained by the existing technique.

Furthermore, since heterodimerized antibody H240-Kn061/H240-Hl071/L73-k0 has the feature of a heterodimerized antibody which is that it binds more strongly to FcgR than homodimerized antibodies comprising each H chain therefrom, H240-Kn072/H240-Hl076/L73-k0 obtained by introducing D270E into both H chains of H240-Kn061/H240-Hl071/L73-k0 is thought to have the same feature of heterodimerized antibody.

[Example 20] Further Improvement of Heterodimerized Antibody H240-Kn072/H240-Hl076/L73-k0

The present inventors tried to further improve H240-Kn072/H240-Hl076/L73-k0, which was discovered in Example 19. Specifically, H240-Kn072/H240-Hl076/L73-k0 was combined with alterations Y234E, Y235N, Y235Q, and S239M that, when introduced into H240-Kn061, additionally confer superior properties to H240-Kn061/H240-Hl071/L73-k0 discovered in Example 18.

H240-Kn113 (SEQ ID NO: 92) resulting from introduction of Y234E and Y235N into H240-Kn072, H240-Kn115 (SEQ ID NO: 93) resulting from introduction of S239M into H240-Kn072, and H240-Kn125 (SEQ ID NO: 94) resulting from introduction of Y235Q and S239M into H240-Kn072 were prepared according to the method described in Reference Example 1. H240-Kn113/H240-Hl076/L73-k0, H240-Kn115/H240-Hl076/L73-k0, and H240-Kn125/H240-Hl076/L73-k0 were prepared by combining H240-Hl076 as an H chain, L73-k0 as the L chain, and H240-Kn113, H240-Kn115, and H240-Kn125 as the other H chain according to the method described in Reference Example 1. Those described above were assessed for the binding to each FcgR according to the method described in Reference Example 8, along with native IgG1 H240-G1d/L73-k0, H240-Kn033/H240-Hl033/L73-k0 modified therefrom using knobs-into-holes, the afucosylated antibody H240-afucosyl_G1d/L73-k0 obtained by the existing ADCC activity-enhancing technique, and the homodimerized antibody H240-Kn032/H240-Hl032/L73-k0 both of whose H chains had been introduced with an ADCC activity-enhancing alteration S239D/A330L/I332E. The results are summarized in Table 51.

TABLE 51

| Sample | FcgRIa KD (M) | FcgRIIa R KD (M) | FcgRIIa H KD (M) | FcgRIIb KD (M) | FcgRIIIa F KD (M) | FcgRIIIa V KD (M) |
|---|---|---|---|---|---|---|
| H240-G1d/L73-k0 | 2.3E−10 | 8.8E−07 | 6.6E−07 | 6.0E−06 | 1.4E−06 | 3.1E−07 |
| H240-Kn033/H240-Hl033/L73-k0 | 2.5E−10 | 1.0E−06 | 9.3E−07 | 4.2E−06 | 2.6E−06 | 3.9E−07 |
| H240-Kn032/H240-Hl032/L73-k0 | 7.3E−11 | 3.4E−07 | 6.9E−07 | 6.3E−07 | 9.1E−09 | 3.1E−09 |
| H240-afucosyl_G1d/L73-k0 | 4.3E−10 | 4.9E−07 | 7.8E−07 | 2.6E−06 | 7.9E−08 | 6.9E−09 |
| H240-Kn072/H240-Hl076/L73-k0 | 1.0E−10 | 7.1E−07 | 1.3E−07 | 5.7E−06 | 2.6E−09 | 1.0E−09 |
| H240-Kn113/H240-Hl076/L73-k0 | 2.1E−10 | 6.0E−07 | 3.5E−07 | 5.0E−06 | 1.7E−09 | 6.2E−10 |
| H240-Kn115/H240-Hl076/L73-k0 | 2.7E−10 | 1.3E−07 | 6.2E−08 | 1.3E−06 | 1.4E−09 | 4.3E−10 |
| H240-Kn125/H240-Hl076/L73-k0 | 2.4E−10 | 3.8E−07 | 1.9E−07 | 4.2E−06 | 1.2E−09 | 3.7E−10 |

When compared to H240-Kn072/H240-Hl076/L73-k0, H240-Kn113/H240-Hl076/L73-k0 showed comparable binding to FcgRIIb, an inhibitory FcgR, and enhanced binding to FcgRIIIa F and FcgRIIIa V that play an important role in ADCC activity. Regarding the binding to FcgRIIb, an inhibitory FcgR, the degree of binding was comparable even when compared to native antibody IgG1. With respect to FcgRIIIa, the binding to FcgRIIIa F and FcgRIIIa V was more enhanced than afucosylated antibody H240-afucosyl_G1d/L73-k0 obtained by the existing ADCC activity-enhancing technique and homodimerized antibody H240-Kn032/H240-Hl032/L73-k0 both of whose H chains had been introduced with ADCC activity-enhancing alterations S239D/A330L/I332E. The findings described above suggest the possibility that H240-Kn113/H240-Hl076/L73-k0 does not increase immunosuppressive actions as compared to native IgG1 and exhibits antitumor effect stronger than that of afucosylated antibody resulting from application of the existing ADCC activity-enhancing alteration and that of the homodimerized antibody.

When compared to H240-Kn113/H240-Hl076/L73-k0, H240-Kn115/H240-Hl076/L73-k0 showed enhanced binding to FcgRIIIa F and FcgRIIIa V, which play an important role in ADCC activity. In addition, the binding to FcgRIIa R and FcgRIIa H, which are important for ADCP activity, was more enhanced than that of native IgG1 H240-G1d/L73-k0, H240-Kn033/H240-Hl033/L73-k0 resulting from application of knobs-into-holes thereto, the afucosylated antibody H240-afucosyl_G1d/L73-k0 obtained by the existing ADCC activity-enhancing technique, and the homodimerized antibody H240-Kn032/H240-Hl032/L73-k0 both of whose H chains had been introduced with ADCC activity-enhancing alterations S239D/A330L/I332E.

As with H240-Kn113/H240-Hl076/L73-k0, H240-Kn125/H240-Hl076/L73-k0 showed more enhanced binding to FcgRIIIa F and FcgRIIIa V, which play an important role in ADCC activity, than H240-Kn115/H240-Hl076/L73-k0, while retaining the binding to FcgRIIb, an inhibitory FcgR, at a comparable level to IgG1. H240-Kn125/H240-Hl076/L73-k0 exhibited enhanced binding to FcgRIIa H, an FcgRIIa allotype as well as reduced FcgRIIb binding and enhanced binding to both FcgRIIIa allotypes as compared to the afucosylated antibody H240-afucosyl_G1d/L73-k0 obtained by the existing ADCC activity-enhancing technique and the homodimerized antibody H240-Kn032/H240-Hl032/L73-k0 both of whose H chains had been introduced with an ADCC activity-enhancing alteration S239D/A330L/I332E. Thus, H240-Kn125/H240-Hl076/L73-k0 can be expected to increase ADCP and ADCC activities and also reduce immunosuppressive actions more strongly than the homodimerized antibody and afucosylated antibody resulting from application of the existing ADCC activity-enhancing alteration.

Then, the ADCC activities of H240-Kn113/H240-Hl076/L73-k0, H240-Kn115/H240-Hl076/L73-k0, and H240-Kn125/H240-Hl076/L73-k0 were compared to those of H240-Kn033/H240-Hl033/L73-k0 and afucosylated antibody H240-afucosyl_G1d/L73-k0 obtained by the existing ADCC activity-enhancing technique. The results are shown in FIG. 42.

As shown in FIG. 42, all the heterodimerized antibodies exhibited more excellent ADCC activity than the afucosylated antibody obtained by the existing ADCC activity-enhancing technique.

The profiles of binding to each FcgR and the result of ADCC activity comparison with the existing technologies demonstrate that Y234E, Y235N, Y235Q, and S239M, which were introduced into H240-Kn072 of H240-Kn072/H240-Hl076/L73-k0, are alterations that confer H240-Kn072/H240-Hl076/L73-k0 with further superior characteristics.

Since heterodimerized antibody H240-Kn061/H240-Hl071/L73-k0 has the feature of a heterodimerized antibody which is that it binds more strongly to FcgR than homodimerized antibodies comprising each H chain therefrom, H240-Kn072/H240-Hl076/L73-k0 obtained by introducing D270E into both H chains of H240-Kn061/H240-Hl071/L73-k0 is expected to have the same feature of heterodimerized antibody. Likewise, H240-Kn113/H240-Hl076/L73-k0, H240-Kn115/H240-Hl076/L73-k0, and H240-Kn125/H240-Hl076/L73-k0 obtained by introducing further alterations into H240-Kn072/H240-Hl076/L73-k0 are also thought to have the same feature of heterodimerized antibody.

[Example 21] Preparation of Heterodimerized Antibodies that Exhibit Enhanced Binding to FcgRIIa and FcgRIIIa Based on the result shown in Example 4, variants with H chains that exhibit enhanced binding to FcgRIIa and FcgRIIIa were prepared. Specifically, H240-Kn067 (SEQ ID NO: 95) was produced by introducing L234Y, L235Y, G236W, H268D, S298A, an A327D into H240-Kn033 (SEQ ID NO: 84), and H240-Hl068 (SEQ ID NO: 96) was produced by introducing D270E, K326D, A330K, and K334E into H240-Hl033 (SEQ ID NO: 85), according to the method described in Reference Example 1. Heterodimerized antibody H240-Kn067/H240-Hl068/L73-k0 was expressed by combining H240-Kn067, H240-Hl068, and L73-k0 according to the method described in Reference Example 1.

First, whether heterodimerized antibody H240-Kn067/H240-Hl068/L73-k0 has the feature of a heterodimerized antibody which is that it enhances the binding activity to FcgR than the homodimerized antibodies comprising each H chain therefrom was assessed. In the heterodimerized antibody H240-Kn067/H240-Hl068/L73-k0, L234Y/L235Y/G236W/H268D/S298A/A327D has been introduced into H240-Kn067 as an H chain and D270E/K326D/A330K/K334E has been introduced into H240-Hl068 as the other H chain. Then, H240-Hl136 (SEQ ID NO: 97) resulting from introduction of L234Y/L235Y/G236W/H268D/S298A/A327D into H240-Hl033 and H240-Kn133 (SEQ ID NO: 98) resulting from introduction of D270E/K326D/A330K/K334E into H240-Kn033 were constructed according to the method described in Reference Example 1. Using these expression vectors, homodimerized antibody H240-Kn067/H240-Hl136/L73-k0 both of whose H chains have L234Y/L235Y/G236W/H268D/S298A/A327D and homodimerized antibody H240-Kn113/H240-Hl068/L73-k0 both of whose H chains have D270E/K326D/A330K/K334E were expressed according to the method described in Reference Example 1. The homodimerized antibodies and heterodimerized antibody H240-Kn067/H240-Hl068/L73-k0 one of whose H chains has L234Y/L235Y/G236W/H268D/S298A/A327D and the other H chain has D270E/K326D/A330K/K334E were assayed for the binding to FcgRIIa H, FcgRIIa R, FcgRIIIaF, and FcgRIIIa V according to the method described in Reference Example 8. The results are summarized in Table 52.

TABLE 52

| Sample | FcgRIIa R KD (M) | FcgRIIa H KD (M) | FcgRIIIa F KD (M) | FcgRIIIa V KD (M) |
|---|---|---|---|---|
| H240-Kn067/ H240-Hl068/ L73-k0 | 4.9E−08 | 9.4E−08 | 7.1E−09 | 1.6E−09 |
| H240-Kn067/ H240-Hl136/ L73-k0 | 9.5E−07 | 2.1E−06 | 9.6E−07 | 3.4E−07 |
| H240-Kn133/ H240-Hl068/ L73-k0 | 4.5E−07 | 1.6E−07 | 1.2E−07 | 1.4E−08 |

Furthermore, based on this variant, H240-Kn067/H240-Hl068/L73-k0 was combined with alterations Y235Q and S239M that, when introduced into H240-Kn061, further confer H240-Kn061/H240-Hl071/L73-k0 with superior characteristics as discovered in Example 18. Specifically, H240-Kn120 (SEQ ID NO: 99) resulting from introduction of S239M into H240-Kn067 and H240-Kn126 (SEQ ID NO: 100) resulting from introduction of Y235Q into H240-Kn120 were prepared according to the method described in Reference Example 1. H240-Kn067/H240-Hl068/L73-k0, H240-Kn120/H240-Hl068/L73-k0, and H240-Kn126/H240-Hl068/L73-k0 were prepared by combining H240-Hl068 as an H chain and L73-k0 as the L chain with H240-Kn067, H240-Kn120, and H240-Kn126 as the other H chain according to the method described in Reference Example 1. Those described above were assayed for the binding to each FcgR according to the method described in Reference Example 8. The results are summarized in Table 53.

TABLE 53

| Sample | FcgRIa KD (M) | FcgRIIa R KD (M) | FcgRIIa H KD (M) | FcgRIIb KD (M) | FcgRIIIa F KD (M) | FcgRIIIa V KD (M) |
|---|---|---|---|---|---|---|
| H240-Kn033/H240-Hl033/L73-k0 | 2.5E−10 | 1.0E−06 | 9.3E−07 | 4.2E−06 | 2.6E−06 | 3.9E−07 |
| H240-Kn032/H240-Hl032/L73-k0 | 7.3E−11 | 3.4E−07 | 6.9E−07 | 6.3E−07 | 9.1E−09 | 3.1E−09 |
| H240-Kn037/H240-Hl036/L73-k0 | 9.8E−11 | 2.9E−08 | 4.6E−08 | 3.8E−07 | 2.1E−08 | 6.8E−09 |
| H240-afucosyl_G1d/L73-k0 | 4.3E−10 | 4.9E−07 | 7.8E−07 | 2.6E−06 | 7.9E−08 | 6.9E−09 |
| H240-Kn067/H240-Hl068/L73-k0 | 2.6E−10 | 4.9E−08 | 9.4E−08 | 3.7E−07 | 7.1E−09 | 1.6E−09 |
| H240-Kn120/H240-Hl068/L73-k0 | 3.7E−10 | 1.7E−08 | 5.9E−08 | 1.5E−07 | 2.4E−09 | 6.6E−10 |
| H240-Kn126/H240-Hl068/L73-k0 | 4.0E−10 | 7.6E−08 | 1.7E−07 | 5.2E−07 | 3.7E−09 | 6.4E−10 |

This result demonstrates that H240-Kn067/H240-Hl068/L73-k0, H240-Kn120/H240-Hl068/L73-k0, and H240-Kn126/H240-Hl068/L73-k0 all exhibit comparable or enhanced FcgRIIIa binding as compared to the existing ADCC activity-enhanced antibodies: H240-afucosyl_G1d/L73-k0 and H240-Kn032/H240-Hl032/L73-k0. Furthermore, the binding to FcgRIIa R and FcgRIIa H, which play an important role in ADCP activity, was enhanced as compared to each of the existing technologies. The above-described finding suggests that all of the heterodimerized antibodies H240-Kn067/H240-Hl068/L73-k0, H240-Kn120/H240-Hl068/L73-k0, and H240-Kn126/H240-Hl068/L73-k0 produced herein have comparable or stronger ADCC activity and superior ADCP activity relative to those achieved by the existing technologies.

In particular, H240-Kn120/H240-Hl068/L73-k0 exhibited more enhanced binding to FcgRIIa R and FcgRIIa H even when compared to the homodimerized antibody H240-Kn037/H240-Hl036/L73-k0 both of whose H chains have alterations G236A/S239D/I332E reported to enhance the binding to FcgRIIa R and FcgRIIa H as well as to increase ADCP activity. Specifically, H240-Kn120/H240-Hl068/L73-k0 exhibits more enhanced binding to FcgRIIIa F and FcgRIIIa V than antibodies obtained by the existing ADCC activity-enhancing technique, and exhibits more enhanced binding to FcgRIIa R and FcgRIIa H than antibodies obtained by the existing ADCP activity-enhancing technique. Thus, H240-Kn120/H240-Hl068/L73-k0 is an antibody that can have stronger ADCC and ADCP activities than antibodies obtained by the existing technologies.

Next, according to Reference Example 9, the ADCC activity of each variant was compared to that of the afucosylated antibody H240-afucosyl_G1d/L73-k0 obtained by the existing ADCC activity-enhancing technique. The result is shown in FIG. 43.

The result shown in FIG. 43 demonstrates that all of the heterodimerized antibodies produced this time have ADCC activity comparable or superior to that of the afucosylated antibody obtained by the existing ADCC activity-enhancing technique.

The profiles of binding to each FcgR and the result of ADCC activity comparison with the existing technologies demonstrate that all of H240-Kn067/H240-Hl068/L73-k0, H240-Kn120/H240-Hl068/L73-k0, and H240-Kn126/H240-Hl068/L73-k0 prepared this time are heterodimerized antibodies that are highly probable to have ADCC activity comparable or superior to that achieved with the existing ADCC activity-enhancing technique as well as increased ADCP activity via the FcgRIIa binding.

[Example 22] Assessment of Heterodimerized Antibody H240-AK072/H240-BH076/L73-k0 for the Binding Activity to Each FcgR and ADCC Activity Hereinabove, H240-Kn072/H240-Hl076/L73-k0, which is a heterodimerized antibody resulting from application of knobs-into-holes, was assessed for its binding to each FcgR and ADCC activity. Herein, whether the feature of a heterodimerized antibody which is that a heterodimerized antibody comprising two different H chains has increased FcgR-binding activity than the homodimerized antibodies comprising each H chain therefrom is also observed even when using D356K, H435R, and K439E as an alternative heterodimerized antibody-producing technique, was assessed.

First, H240-AK072 (SEQ ID NO: 104) was constructed by introducing L234Y/L235Y/G236W/H268D/D270E/S298A, an alteration introduced into H240-Kn072 that is an H chain of H240-Kn072/H240-Hl076/L73-k0, into H240-A5E (SEQ ID NO: 102) resulting from introduction of D356K and H435R into H240-G1dE (SEQ ID NO: 101), which is an allotype of H240-G1d (SEQ ID NO: 83). Then, H240-BH076 (SEQ ID NO: 105) was constructed by introducing D270E/K326D/A330M/K334E, which was introduced into H240-Hl076 as the other H chain, into H240-B3E (SEQ ID NO: 103) resulting from introduction of K439E into H240-G1DE. The heterodimerized antibody H240-AK072/H240-BH076/L73-k0 was expressed and prepared by combining H240-AK072, H240-BH076, and L73-k0 according to the method described in Example 1. Similarly, H240-AK072 and L73-k0, and H240-BH076 and L73-k0 were each combined to express and prepare the homodimerized antibodies H240-AK072/L73-k0 and H240-BH076/L73-k0. The antibodies were compared for the binding to each FcgR according to the method described in Reference Example 8. The results are summarized in Table 54.

TABLE 54

| Sample | FcgRIIIa F KD (M) | FcgRIIIa V KD (M) |
|---|---|---|
| H240-AK072/L73-k0 | 3.0E−07 | 2.9E−08 |
| H240-BH076/L73-k0 | 2.6E−08 | 5.3E−09 |
| H240-AK072/H240-BH076/L73-k0 | 3.7E−09 | 9.8E−10 |

The results described above confirm that the heterodimerized antibody H240-AK072/H240-BH076/L73-k0 has the feature of a heterodimerized antibody which is that it binds to FcgR more strongly than homodimeric antibodies H240-AK072/L73-k0 and H240-BH076/L73-k0 each of which comprises either H chain therefrom.

Then, H240-A5E, H240-B3E, and L73-k0 were combined and expressed to prepare H240-A5E/H240-B3E/L73-k0 according to the method described in Reference Example 1. H240-G1d/L73-k0, H240-A5E/H240-B3E/L73-k0, H240-afucosyl_G1d/L73-k0, and the heterodimerized antibody H240-AK072/H240-BH076/L73-k0 were assessed for the binding to each FcgR according to the method described in Reference Example 8. The results are summarized in Table 55.

TABLE 55

| Sample | FcgRIa KD (M) | FcgRIIa R KD (M) | FcgRIIa H KD (M) | FcgRIIb KD (M) | FcgRIIIa F KD (M) | FcgRIIIa V KD (M) |
|---|---|---|---|---|---|---|
| H240-G1d/L73-k0 | 2.3E−10 | 8.8E−07 | 6.6E−07 | 6.1E−06 | 1.4E−06 | 3.1E−07 |
| H240-A5E/H240-B3E/L73-k0 | 6.1E−10 | 9.4E−07 | 9.1E−07 | 4.3E−06 | 1.6E−06 | 3.3E−07 |
| H240-afucosyl_G1d/L73-k0 | 4.3E−10 | 4.9E−07 | 7.8E−07 | 2.6E−06 | 7.9E−08 | 6.9E−09 |
| H240-AK072/H240-BH076/L73-k0 | 2.4E−10 | 4.6E−07 | 1.3E−07 | 2.9E−06 | 3.7E−09 | 9.8E−10 |

The results show that the binding of H240-AK072/H240-BH076/L73-k0 to FcgRIIIa F and FcgRIIIa V was enhanced as compared to H240-G1d/L73-k0 and afucosyl antibody H240-afucosyl_G1d/L73-k0 obtained with the existing ADCC activity-enhancing technique. Meanwhile, since the FcgR-binding activity was comparable between H240-G1d/L73-k0 and H240-A5E/H240-B3E/L73-k0, the increased binding activity of H240-AK072/H240-BH076/L73-k0 was thought to be due to alterations L234Y/L235Y/G236W/H268D/D270E/S298A and D270E/K326D/A330M/K334E introduced into the each of H chains.

[Example 23] X-Ray Crystal Structure Analysis of a Complex of Fc (Kn120/Hl068) and FcgRIIb Extracellular Region H240-Kn120/H240-Hl068/L73-k0 produced as described in Example 21 not only had increased binding activity to FcgRIIIa and FcgRIIa type H and to FcgRIIa R allotype but also had increased binding activity to FcgRIIb, an inhibitory receptor. The enhanced FcgRIIb binding is thought to cause immunosuppressive effects. Thus, reducing the binding to FcgRIIb would be able to achieve further enhancement of ADCC activity, which is an objective of the present invention.

However, 93% of the amino acid sequence of the extracellular region of FcgRIIa and FcgRIIb match, and are highly homologous to each other. Furthermore, according to an analysis based on the crystallographic structure (J. Imunol. 2011, 187, 3208-3217) of the complex between Fc of native IgG1 (hereinafter abbreviated as Fc (WT)) and the extracellular region of FcgRIIa type R, near interacting interfaces between the both proteins, only three amino acids (Gln127, Leu132, and Phe160) in FcgRIIa type R were different when compared to FcgRIIb (FIG. 44). For this reason, it was predicted that it was extremely difficult to reduce the FcgRIIb-binding activity alone while retaining the binding activity to FcgRIIa type R. Then, the present inventors conceived that, if they obtained information about the crystallographic structure of the complex between the Fc portion (Fc (Kn120/Hl068)) of H240-Kn120/H240-Hl068/L73-k0 and FcgRIIb extracellular region and investigated the amino acid mutations to be introduced in more detail, the possibility of revealing an alteration that selectively reduces the FcgRIIb-binding activity would be increased. Thus, the complex between Fc (Kn120/Hl068) and FcgRIIb extracellular region was analyzed by X-ray crystal structure analysis.

As a result, the present inventors succeeded in determining the three-dimensional structure of the complex of Fc (Kn120/Hl068)/FcgRIIb extracellular region at 2.78 Å resolution by X-ray crystal structure analysis. The structure obtained as a result of the analysis is shown in FIG. 45. FcgRIIb extracellular region was revealed to be bound and sandwiched between two Fc CH2 domains, which resembles the three-dimensional structures of the previously analyzed complexes between Fc (WT) and the respective extracellular regions of FcgRIIIa (Proc. Natl. Acad. Sci. USA, 2011, 108, 12669-126674), FcgRIIIb (Nature, 2000, 400, 267-273; J. Biol. Chem. 2011, 276, 16469-16477), and FcgRIIa.

Next, the structures around three amino acid residues, which are near the binding interface to Fc and are different between FcgRIIa type R and FcgRIIb, are described. FIG. 46 shows the structure around Lys127 (Gln in FcgRIIa type R). The closest residue in FcgRIIb is Ala at position 298 (EU numbering) located in CH2 domain B of Fc shown in FIG. 46. This residue is in direct contact with FcgRIIb at the binding interface. Therefore, it was thought that introduction of any bulky residue capable of interacting with Lys127 was difficult. Other surrounding amino acid residues are too distant from Lys127, and no mutations capable of direct interaction could be found. FIG. 47 shows the structure around Ser132 (Leu in FcgRIIa type R). This residue is also too distant from Fc, and no mutations capable of direct interaction with this Ser could be found. Finally, FIG. 48 shows the structure around Tyr160 (Phe in FcgRIIa type R). This Tyr forms a hydrogen bond with the main chain carbonyl oxygen of Gly at position 236 (EU numbering) in CH2 domain A of Fc. In this case, the FcgRIIb-binding activity alone may be reduced by introducing a mutation at Gly236 at position 236 (EU numbering), if the mutation causes a change of the loop structure and thereby eliminates the hydrogen bond. Further, when a mutation with any bulky side chain is introduced at the position of Gly at position 236 (EU numbering), the side chain is predicted to interact directly with the side chain at position 160 in FcgRIIa or FcgRIIb, and the FcgRIIb binding activity may be selectively reduced by using the difference between Phe160 in FcgR2a type R and Tyr160 in FcgRIIb.

Experimental Method

[Expression and Purification of Fc (Kn0120/Hl068)]

An Fc (Kn0120/Hl068) was prepared as follows. First, Cys at position 220 (EU numbering) of H240-Kn120 (SEQ ID NO: 99) and H240-Hl068 (SEQ ID NO: 96) was substituted with Ser. Then, genetic sequence of Fc (Kn0120) and Fc (Hl068) from Glu at position 236 (EU numbering) to its C terminal was cloned by PCR. Using this cloned genetic sequence, production of expression vectors, and expression and purification of Fc (Kn0120) and Fc (Hl068) were carried out according to the method of Reference Example 1. Cys at position 220 (EU numbering) forms a disulfide bond with Cys of the L chain in general IgG1. The L chain is not co-expressed when Fc alone is prepared, and therefore, this residue was substituted with Ser to avoid formation of unnecessary disulfide bonds.

[Expression and Purification of the FcgRIIb Extracellular Region]

This was prepared according to the method of Reference Example 8.

[Purification of the Fc (Kn120/Hl068)/FcgRIIb Extracellular Region Complex]

To 1.5 mg of the FcgRIIb extracellular region sample obtained for crystallization, 0.15 mg of Endo F1 (Protein Science 1996, 5: 2617-2622) expressed and purified from *Escherichia coli* as a glutathione S-transferase fusion protein was added. This was allowed to remain at room temperature for three days in 0.1 M Bis-Tris buffer at pH 6.5, and the N-linked oligosaccharide was cleaved, leaving N-acetylglucosamine directly bound to Asn. Next, this FcgRIIb extracellular region sample subjected to carbohydrate cleavage treatment was concentrated by ultrafiltration with 10000 MWCO, and purified by gel filtration chromatography (Superdex200 10/300) using a column equilibrated in 20 mM HEPES at pH 7.5 containing 0.1 M NaCl. Furthermore, to the obtained carbohydrate-cleaved FcγRIIb extracellular region fraction, Fc(Kn0120/Hl068) was added so that the molar ratio of the FcgRIIb extracellular region would be present in slight excess, and after concentration by ultrafiltration with 10,000 MWCO, a sample of the Fc (Kn0120/Hl068)/FcgRIIb extracellular region complex was obtained through purification by gel filtration chromatography (Superdex200 10/300) using a column equilibrated in 25 mM HEPES at pH 7.5 containing 0.1 M NaCl.

[Crystallization of the Fc (Kn120/Hl068)/FcgRIIb Complex Extracellular Region Complex]

A sample of the Fc (Kn120/Hl068)/FcgRIIb extracellular region complex was concentrated to approximately 10 mg/mL by ultrafiltration with 10,000 MWCO, and crystallization was carried out by the hanging drop vapor diffusion method in combination with seeding method. VDXm plate (Hampton Research) was used for crystallization. Using a reservoir solution containing 0.1 M Bis-Tris (pH 6.0), 14.4% PEG3350, and 0.2 M ammonium sulfate, crystallization drops were prepared at a mixing ratio of reservoir solution: crystallization sample=0.85 µl:0.85 µl. Then, streak seeding was performed using Seeding Tool (Hampton Research) to transfer seed crystals from the crystals of the complex obtained under the same condition. The drops were allowed to stand at 20° C. This successfully yielded columnar crystals.

[Measurement of X-Ray Diffraction Data from an Fc (Kn120/Hl068)/FcgRIIb Extracellular Region Complex Crystal]

One of the obtained single crystals of the Fc (Kn120/Hl068)/FcgRIIb extracellular region complex was soaked into a solution of 0.1 M Bis-Tris pH 6.0, 17.5% PEG3350, 0.2 M ammonium sulfate, glycerol 16% (v/v). The crystal was fished out of the solution using a pin with attached tiny nylon loop, and frozen in liquid nitrogen; and then X-ray diffraction data was measured at synchrotron radiation facility Photon Factory BL-17A in High Energy Accelerator Research Organization. During the measurement, the crystal was constantly placed in a nitrogen stream at −178° C. to maintain in a frozen state, and a total of 360 X ray diffraction images were collected using Quantum 315r CCD detector (ADSC) attached to a beam line with rotating the crystal 0.5° at a time. Determination of cell parameters, indexing of diffraction spots, and diffraction data processing from the obtained diffraction images were performed using the Xia2 program (J. Appl. Cryst. 2010, 43: 186-190), XDS Package (Acta. Cryst. 2010, D66: 125-132) and Scala (Acta. Cryst. 2006, D62: 72-82); and finally, diffraction intensity data up to 2.78 Å resolution was obtained. The crystal belongs to the space group $P4_12_12$, and has the following cell parameters; a=152.94 Å, b=152.94 Å, c=82.24 Å, α=90°, β=90°, γ=90°.

[X Ray Crystallographic Analysis of the Fc (Kn120/Hl068)/FcgRIIb Extracellular Region Complex]

Crystal structure of the Fc (Kn120/Hl068)/FcgRIIb extracellular region complex was determined by the molecular replacement method using the program Phaser ((J. Appl. Cryst. 2007, 40: 658-674). From the size of the obtained crystal lattice and the molecular weight of the Fc (Kn120/Hl068)/FcgRIIb extracellular region complex, the number of complexes in the asymmetric unit was predicted to be one. From the structural coordinates of PDB code: 3SGJ which is the crystal structure of the Fc(WT)/FcgRIIIa extracellular region complex, the amino acid residue portions of the A chain positions 239-340 and the B chain positions 239-340 were taken out as separate coordinates, and they were used respectively as models for searching the Fc CH2 domains. The amino acid residue portions of the A chain positions 341-444 and the B chain positions 341-443 were taken out as a single set of coordinates from the same structural coordinates of PDB code: 3SGJ; and this was used as a model for searching the Fc CH3 domains. Finally, from the structural coordinates of PDB code: 2FCB which is a crystal structure of the FcgRIIb extracellular region, the amino acid residue portions of the A chain positions 6-178 was taken out and used as a model for searching the FcgRIIb. The orientation and position of each search model in the crystal lattice were determined for Fc CH3 domain, FcgRIIb extracellular region, and Fc CH2 domain, based on the rotation function and translation function to obtain the initial model for the crystal structure of the Fc (Kn120/Hl068)/FcgRIIb extracellular region complex. When rigid body refinement which moves the two Fc CH2 domains, the two Fc CH3 domains, and the FcgRIIb extracellular region was performed on the obtained initial model, the crystallographic reliability factor, R value became 41.4%, and the Free R value became 42.6% to diffraction intensity data from 25 Å to 3.0 Å at this point. Furthermore, structural refinement using the program REFMACS (Acta Cryst. 2011, D67, 355-367), and revision of the model to observe the electron density maps whose coefficient have 2Fo-Fc or Fo-Fc, which are calculated based on the experimentally determined structural factor Fo, the calculated structural factor Fc and the calculated phase using the model, was carried out by the Coot program (Acta Cryst. 2010, D66: 486-501), and model refinement was carried out by repeating these steps. Finally, as a result of incorporation of water molecules into the model based on the electron density maps which use 2Fo-Fc or Fo-Fc as the coefficient, and the following refinement, the crystallographic reliability factor, R values and the Free R value of the model contain-

[Example 24] Preparation of Antibodies Retaining the FcgRIIaR-Binding Activity or Having Increased FcgRIIaR-Binding Activity, and Having Reduced FcgRIIb-Binding Activity Variant H240-Kn120/H240-Hl068/L73-k0 discovered in Example 21 had increased binding activity to FcgRIIaR and FcgRIIaH that are important for ADCP activity, and in addition, its binding activity to inhibitory FcgRIIb was increased to about 50 times that of native IgG1. In order to achieve high ADCP activity, it is preferable to reduce the binding activity to inhibitory FcgRIIb as much as possible. Thus, the present inventors searched for alterations that enable reduction of the FcgRIIb-binding activity while retaining the binding activity to activating FcgRIIaR and FcgRIIaH. As described in Example 23, the result of crystallographic analysis of the complex between Fc of H240-Kn120/H240-Hl068/L73-k0 and FcgRIIb extracellular region showed that Tyr160 in FcgRIIb formed a hydrogen bond with the main chain carbonyl oxygen of Gly236 present in CH2 domain A of Fc (Kn120/Hl068). In FcgRIIaR and FcgRIIaH, the corresponding position is occupied by Phe160, and the above-described interaction is unlikely to be present. This suggests the possibility that, if the interaction to Tyr160 in FcgRIIb can be eliminated by introducing an alteration at Gly236, the FcgRIIb-binding activity may be reduced while retaining the binding activity to FcgRIIa type R, i.e., the FcgRIIb-binding activity can be selectively reduced. Specifically, the present inventors conceived that the interaction to Y160 could be eliminated if reversion of G236 and alteration of the loop structure was introduced by substituting Ser, Val, Ile, or Thr for G236 in the H chain derived from H240-Hl068 that interacts with Y160 of FcgRIIb in the binding between FcgRIIb and H240-Kn120/H240-Hl068/L73-k0. Meanwhile, though distant, Lys127 of FcgRIIb may be in electrostatic interaction with E294 of CH2 domain A of Fc (Kn120/Hl068). Thus, the present inventors considered the possibility that the interaction with FcgRIIb may be reduced by inducing electrostatic repulsion by substituting E294 with positively charged Lys or Arg.

H240-Kn179 (SEQ ID NO: 107) and H240-Kn180 (SEQ ID NO: 108) resulting from introduction of each of E294R and E294K into H240-Kn120 (SEQ ID NO: 99), and H240-Hl073 (SEQ ID NO: 109), H240-Hl085 (SEQ ID NO: 110), H240-Hl086 (SEQ ID NO: 111), and H240-Hl089 (SEQ ID NO: 112) resulting from introduction of each of G236S, G236V, G236I, and G236T into H240-Hl068 (SEQ ID NO: 96), were prepared according to the method described in Reference Example 1. H240-Kn120/H240-Hl073/L73-k0, H240-Kn120/H240-Hl085/L73-k0, H240-Kn120/H240-Hl086/L73-k0, H240-Kn120/H240-Hl089/L73-k0, H240-Kn179/H240-Hl068/L73-k0, and H240-Kn180/H240-Hl068/L73-k0 were prepared by combining each of H240-Kn120 and H240-Kn180 as an H chain, L73-k0 as the L chain, and H240-Hl073, H240-Hl085, H240-Hl086, and H240-Hl089 as the other H chain according to the method described in Reference Example 1. The variants described above were assessed for their binding to FcgR according to the method described in Reference Example 8. The results are shown in Table 56. The KD of H240-Kn120/H240-Hl073/L73-k0 in the FcgRIa column of the table was calculated under the assumption that kd is 5×10-5 s-1 or less, because the value of kd for FcgRIa was smaller than the measurement limit 5×10-5 s-1 out of the measurable range of 5×10-5 s-1 to 1 s-1 for dissociation constant (kd) in Biacore4000 used in the assay.

TABLE 56

| Sample | FcgRIa KD (M) | FcgRIIaR KD (M) | FcgRIIaH KD (M) | FcgRIIb KD (M) | FcgRIIIaF KD (M) | FcgRIIIaV KD (M) |
|---|---|---|---|---|---|---|
| H240-Kn120/H240-HI068/L73-k0 | 1.6E−10 | 2.0E−08 | 4.1E−08 | 1.5E−07 | 2.2E−09 | 3.6E−10 |
| H240-Kn120/H240-HI073/L73-k0 | <2.8E−11 | 1.5E−08 | 2.1E−08 | 2.1E−07 | 8.2E−09 | 1.8E−09 |
| H240-Kn120/H240-HI085/L73-k0 | 8.7E−08 | 1.9E−08 | 4.6E−08 | 3.9E−07 | 2.3E−08 | 6.2E−09 |
| H240-Kn120/H240-HI086/L73-k0 | 1.4E−09 | 2.2E−08 | 5.3E−08 | 4.8E−07 | 3.3E−08 | 1.4E−08 |
| H240-Kn120/H240-HI089/L73-k0 | 1.8E−10 | 1.4E−08 | 4.1E−08 | 1.9E−07 | 1.2E−08 | 5.4E−09 |
| H240-Kn179/H240-HI068/L73-k0 | 3.0E−10 | 2.6E−08 | 4.1E−08 | 2.6E−07 | 4.8E−09 | 9.8E−10 |
| H240-Kn180/H240-HI068/L73-k0 | 3.0E−10 | 2.1E−08 | 3.3E−08 | 2.4E−07 | 3.1E−09 | 6.7E−10 |

Furthermore, values obtained by dividing KD of H240-Kn120/H240-HI068/L73-k0 for each of FcgRIIaR, FcgRIIaH, and FcgRIIb by KD of each variant, the relative KD determined when taking, as 1, the KD of H240-Kn120/H240-HI068/L73-k0 for FcgRIIaR, FcgRIIaH, or FcgRIIb are shown in Table 57.

TABLE 57

| sample | FcgRIIaR Relative KD | FcgRIIaH Relative KD | FcgRIIb Relative KD | FcgRIIIaF Relative KD | FcgRIIIaV Relative KD |
|---|---|---|---|---|---|
| H240-Kn120/H240-HI068/L73-k0 | 1.0 | 1.0 | 1.0 | 1.0 | 1.0 |
| H240-Kn120/H240-HI073/L73-k0 | 1.3 | 2.0 | 0.7 | 0.3 | 0.2 |
| H240-Kn120/H240-HI085/L73-k0 | 1.1 | 0.9 | 0.4 | 0.1 | 0.1 |
| H240-Kn120/H240-HI086/L73-k0 | 0.9 | 0.8 | 0.3 | 0.1 | 0.0 |
| H240-Kn120/H240-HI089/L73-k0 | 1.4 | 1.0 | 0.8 | 0.2 | 0.1 |
| H240-Kn179/H240-HI068/L73-k0 | 0.8 | 1.0 | 0.6 | 0.5 | 0.4 |
| H240-Kn180/H240-HI068/L73-k0 | 1.0 | 1.2 | 0.6 | 0.7 | 0.5 |

The results demonstrate that all of the six types of alterations produced for this assessment retained or increased the binding activities to FcgRIIaR and FcgRIIaH and reduced the FcgRIIb-binding activity as compared to H240-Kn120/H240-HI068/L73-k0.

Next, the alterations examined in Table 57 were combined to further reduce the FcgRIIb-binding activity. In this experiment, the present inventors aimed to further suppress the FcgRIIb-binding activity by the combined use of introduction of E294K or E294R into H240-Kn120 and introduction of G236T into H240-HI068. As shown in Table 57, all the alterations reduce the binding activities to FcgRIIIa F and FcgRIIIa V. Then, in addition to these alterations, I332E that has been reported to increase the FcgRIIIa-binding activity and the alteration Y235N that increases the FcgRIIIa-binding activity as described in Example 18 were introduced, in an aim to further suppress the FcgRIIb-binding activity and increase the FcgRIIIa-binding activity.

H240-Kn192 (SEQ ID NO: 113) resulting from introduction of Y235N and E294K into H240-Kn120 (SEQ ID NO: 99), H240-Kn193 (SEQ ID NO: 114) resulting from introduction of Y235N and E294R into H240-Kn120 (SEQ ID NO: 99), and H240-HI204 (SEQ ID NO: 115) resulting from introduction of G236T and I332E into H240-HI068 (SEQ ID NO: 96) were prepared according to the method described in Reference Example 1. H240-Kn179/H240-HI089/L73-k0, H240-Kn180/H240-HI089/L73-k0, H240-Kn192/H240-HI204/L73-k0, and H240-Kn193/H240-HI204/L73-k0 were prepared by combining each of H240-Kn192 and H240-Kn193 as an H chain, L73-k0 as the L chain, and H240-HI089 and H240-HI204 as the other H chain according to the method described in Reference Example 1. The variants described above were assessed for their binding to FcγR according to the method described in Reference Example 8. The result is shown in Table 58. The KDs of H240-Kn192/H240-HI204/L73-k0 and H240-Kn193/H240-HI204/L73-k0 shown in the FcgRIa column of the table were calculated under the assumption that kd is $5\times10^{-5}$ $s^{-1}$ or less, because the value of kd for FcγRIa was smaller than the measurement limit $5\times10^{-5}$ $s^{-1}$ out of the measurable range of $5\times10^{-5}$ $s^{-1}$ to 1 $s^{-1}$ for dissociation constant (kd) in Biacore4000 used in the assay.

TABLE 58

| Sample | FcgRIa KD (M) | FcgRIIaR KD (M) | FcgRIIaH KD (M) | FcgRIIb KD (M) | FcgRIIIaF KD (M) | FcgRIIIaV KD (M) |
|---|---|---|---|---|---|---|
| H240-Kn120/H240-HI068/L73-k0 | 1.6E−10 | 2.0E−08 | 4.1E−08 | 1.5E−07 | 2.2E−09 | 3.6E−10 |
| H240-Kn120/H240-HI089/L73-k0 | 1.8E−10 | 1.4E−08 | 4.1E−08 | 1.9E−07 | 1.2E−08 | 5.4E−09 |
| H240-Kn179/H240-HI068/L73-k0 | 3.0E−10 | 2.6E−08 | 4.1E−08 | 2.6E−07 | 4.8E−09 | 9.8E−10 |
| H240-Kn180/H240-HI068/L73-k0 | 3.0E−10 | 2.1E−08 | 3.3E−08 | 2.4E−07 | 3.1E−09 | 6.7E−10 |
| H240-Kn179/H240-HI089/L73-k0 | 4.6E−10 | 1.8E−08 | 4.7E−08 | 4E−07 | 3.9E−08 | 1.8E−08 |
| H240-Kn180/H240-HI089/L73-k0 | 2.7E−10 | 1.6E−08 | 3.8E−08 | 3.8E−07 | 2.4E−08 | 1.4E−08 |
| H240-Kn192/H240-HI204/L73-k0 | <1.9E−11 | 1.9E−08 | 4.2E−08 | 2.9E−07 | 1.2E−08 | 2.2E−09 |
| H240-Kn193/H240-HI204/L73-k0 | <2.4E−11 | 1.6E−08 | 3.5E−08 | 2.9E−07 | 1.1E−08 | 1.8E−09 |

TABLE 58

| Sample | FcgRIa KD (M) | FcgRIIaR KD (M) | FcgRIIaH KD (M) | FcgRIIb KD (M) | FcgRIIIaF KD (M) | FcgRIIIaV KD (M) |
|---|---|---|---|---|---|---|
| H240-Kn120/H240-HI068/L73-k0 | 1.6E−10 | 2.0E−08 | 4.1E−08 | 1.5E−07 | 2.2E−09 | 3.6E−10 |
| H240-Kn120/H240-HI089/L73-k0 | 1.8E−10 | 1.4E−08 | 4.1E−08 | 1.9E−07 | 1.2E−08 | 5.4E−09 |
| H240-Kn179/H240-HI068/L73-k0 | 3.0E−10 | 2.6E−08 | 4.1E−08 | 2.6E−07 | 4.8E−09 | 9.8E−10 |
| H240-Kn180/H240-HI068/L73-k0 | 3.0E−10 | 2.1E−08 | 3.3E−08 | 2.4E−07 | 3.1E−09 | 6.7E−10 |
| H240-Kn179/H240-HI089/L73-k0 | 4.6E−10 | 1.8E−08 | 4.7E−08 | 4E−07 | 3.9E−08 | 1.8E−08 |
| H240-Kn180/H240-HI089/L73-k0 | 2.7E−10 | 1.6E−08 | 3.8E−08 | 3.8E−07 | 2.4E−08 | 1.4E−08 |
| H240-Kn192/H240-HI204/L73-k0 | <1.9E−11 | 1.9E−08 | 4.2E−08 | 2.9E−07 | 1.2E−08 | 2.2E−09 |
| H240-Kn193/H240-HI204/L73-k0 | <2.4E−11 | 1.6E−08 | 3.5E−08 | 2.9E−07 | 1.1E−08 | 1.8E−09 |

Furthermore, values obtained by dividing KD of H240-Kn120/H240-Hl068/L73-k0 for each of FcgRIIaR, FcgRIIaH, and FcgRIIb by KD of each variant, the relative KD determined when taking, as 1, the KD of H240-Kn120/H240-Hl068/L73-k0 for FcgRIIaR, FcgRIIaH, or FcgRIIb are shown in Table 59.

TABLE 59

| sample | FcgRIIaR Relative KD | FcgRIIaH Relative KD | FcgRIIb Relative KD | FcgRIIIaF Relative KD | FcgRIIIaV Relative KD |
|---|---|---|---|---|---|
| H240-Kn120/H240-Hl068/L73-k0 | 1.0 | 1.0 | 1.0 | 1.0 | 1.0 |
| H240-Kn120/H240-Hl089/L73-k0 | 1.4 | 1.0 | 0.8 | 0.2 | 0.1 |
| H240-Kn179/H240-Hl068/L73-k0 | 0.8 | 1.0 | 0.6 | 0.5 | 0.4 |
| H240-Kn180/H240-Hl068/L73-k0 | 1.0 | 1.2 | 0.6 | 0.7 | 0.5 |
| H240-Kn179/H240-Hl089/L73-k0 | 1.1 | 0.9 | 0.4 | 0.1 | 0.0 |
| H240-Kn180/H240-Hl089/L73-k0 | 1.3 | 1.1 | 0.4 | 0.1 | 0.0 |
| H240-Kn192/H240-Hl204/L73-k0 | 1.1 | 1.0 | 0.5 | 0.2 | 0.2 |
| H240-Kn193/H240-Hl204/L73-k0 | 1.3 | 1.2 | 0.5 | 0.2 | 0.2 |

H240-Kn179/H240-Hl089/L73-k0 and H240-Kn180/H240-Hl089/L73-k0, resulting from introduction of E294K or E294R into H240-Kn120 and introduction of G236T into H240-Hl068, both exhibited enhanced binding to FcgRIIaR and FcgRIIaH as compared to H240-Kn120/H240-Hl068/L73-k0, while their FcgRIIb binding was reduced to 0.4 times that of H240-Kn120/H240-Hl068/L73-k0. Furthermore, the effect to reduce the FcgRIIb binding was 1.5 times to twice when compared to H240-Kn120/H240-Hl089/L73-k0, H240-Kn179/H240-Hl068/L73-k0, and H240-Kn180/H240-Hl068/L73-k0, only one of whose chains has each alteration.

H240-Kn192/H240-Hl204/L73-k0 and H240-Kn193/H240-Hl204/L73-k0 resulting from introduction of I332E and Y235N into the above variants both retained the binding to FcgRIIaR, FcgRIIaH, and FcgRIIb and enhanced the FcgRIIIaF and FcgRIIIaV binding to twice and 8 times, respectively, compared to H240-Kn179/H240-Hl089/L73-k0 and H240-Kn180/H240-Hl089/L73-k0 before introduction of the alterations.

[Example 25] Enhancement of the Binding Activity of the Heterodimerized Antibody H240-Kn120/H240-Hl068/L73-k0 to Activating FcgR In Example 24, variants having reduced binding activity to inhibitory FcgRIIb while retaining or enhancing the binding to FcgRIIaR and FcgRIIaH were produced by introducing alterations into H240-Kn120/H240-Hl068/L73-k0. In this examination, the present inventors tried to increase the binding activity to activating FcgRs: FcgRIIaR, FcgRIIaH, FcgRIIIaF, and FcgRIIIaV.

H240-Kn138 (SEQ ID NO: 116) resulting from introduction of L328W into H240-Kn120; H240-Kn173 (SEQ ID NO: 117) resulting from introduction of I332Q into H240-Kn120; H240-Kn178 (SEQ ID NO: 118) resulting from introduction of K334Y into H240-Kn120; H240-Kn166 (SEQ ID NO: 119) resulting from introduction of L328A into H240-Kn120; H240-Kn172 (SEQ ID NO: 120) resulting from introduction of I332M into H240-Kn120; and H240-Kn149 (SEQ ID NO: 121) resulting from introduction of L328W and K334L into H240-Kn120 were prepared according to the method described in Reference Example 1. Furthermore, H240-Hl147 (SEQ ID NO: 122) resulting from introduction of L328W into H240-Hl068; H240-Hl170 (SEQ ID NO: 123) resulting from introduction of L328A into H240-Hl068; H240-Hl174 (SEQ ID NO: 124) resulting from introduction of I332E into H240-Hl068; H240-Hl150 (SEQ ID NO: 125) resulting from introduction of I332T into H240-Hl068; H240-Hl182 (SEQ ID NO: 126) resulting from introduction of A231H into H240-Hl068; and H240-Hl177 (SEQ ID NO: 127) resulting from introduction of I332Q into H240-Hl068 were prepared as the other H chain. H240-Kn120/H240-Hl170/L73-k0, H240-Kn120/H240-Hl150/L73-k0, H240-Kn138/H240-Hl068/L73-k0, H240-Kn120/H240-Hl174/L73-k0, H240-Kn173/H240-Hl068/L73-k0, H240-Kn178/H240-Hl068/L73-k0, H240-Kn120/H240-Hl182/L73-k0, H240-Kn138/H240-Hl147/L73-k0, H240-Kn166/H240-Hl170/L73-k0, H240-Kn172/H240-Hl177/L73-k0, and H240-Kn149/H240-Hl068/L73-k0 were prepared according to the method described in Reference Example 1 using L73-k0 (SEQ ID NO: 106) as the L chain, H240-Kn138 (SEQ ID NO: 116), H240-Kn173 (SEQ ID NO: 117), H240-Kn178 (SEQ ID NO: 118), H240-Kn149 (SEQ ID NO: 121), H240-Kn166 (SEQ ID NO: 119), and H240-Kn172 (SEQ ID NO: 120) as an H chain, and H240-Hl170 (SEQ ID NO: 123), H240-Hl150 (SEQ ID NO: 125), H240-Hl174 (SEQ ID NO: 124), H240-Hl182 (SEQ ID NO: 126), H240-Hl147 (SEQ ID NO: 122), and H240-Hl177 (SEQ ID NO: 127) as the other H chain. These variants were assessed for the FcgR binding according to the method described in Reference Example 8. The results are shown in Table 60.

TABLE 60

| Sample | FcgRIa KD (M) | FcgRIIaR KD (M) | FcgRIIaH KD (M) | FcgRIIb KD (M) | FcgRIIIaF KD (M) | FcgRIIIaV KD (M) | ALTERATION INTRODUCED INTO H240-Kn120 | ALTERATION INTRODUCED INTO H240-Hl068 |
|---|---|---|---|---|---|---|---|---|
| H240-Kn120/H240-Hl068/L73-k0 (SEQ ID NO 99/SEQ ID NO 96/SEQ ID NO 106) | 1.6E−10 | 2.0E−08 | 4.1E−08 | 1.5E−07 | 2.2E−09 | 3.6E−10 | | |
| H240-Kn120/H240-Hl170/L73-k0 (SEQ ID NO 99/SEQ ID NO 123/SEQ ID NO 106) | 1.9E−10 | 8.6E−09 | 1.8E−08 | 6.7E−08 | 3.9E−09 | 9.3E−10 | | L328A |

TABLE 60-continued

| Sample | FcgRIa KD (M) | FcgRIIaR KD (M) | FcgRIIaH KD (M) | FcgRIIb KD (M) | FcgRIIIaF KD (M) | FcgRIIIaV KD (M) | ALTERATION INTRODUCED INTO H240-Kn120 | ALTERATION INTRODUCED INTO H240-Hl068 |
|---|---|---|---|---|---|---|---|---|
| H240-Kn120/H240-Hl150/L73-k0 (SEQ ID NO 99/SEQ ID NO 125/SEQ ID NO 106) | 3.9E−10 | 2.0E−08 | 3.5E−08 | 9.8E−08 | 3.0E−09 | 5.7E−10 | | I332T |
| H240-Kn138/H240-Hl068/L73-k0 (SEQ ID NO 116/SEQ ID NO 96/SEQ ID NO 106) | 1.6E−10 | 1.9E−08 | 2.5E−08 | 1.3E−07 | 3.7E−09 | 4.3E−10 | L328W | |
| H240-Kn120/H240-Hl174/L73-k0 (SEQ ID NO 99/SEQ ID NO 124/SEQ ID NO 106) | 1.4E−10 | 3.0E−08 | 5.5E−08 | 1.3E−07 | 5.1E−10 | 3.6E−11 | | I332E |
| H240-Kn173/H240-Hl068/L73-k0 (SEQ ID NO 117/SEQ ID NO 96/SEQ ID NO 106) | 1.2E−10 | 4.0E−08 | 5.7E−08 | 2.8E−07 | 1.8E−09 | 4.0E−10 | I332Q | |
| H240-Kn178/H240-Hl068/L73-k0 (SEQ ID NO 118/SEQ ID NO 96/SEQ ID NO 106) | 2.3E−10 | 2.6E−08 | 6.5E−08 | 1.1E−07 | 1.4E−09 | 1.9E−10 | K334Y | |
| H240-Kn120/H240-Hl182/L73-k0 (SEQ ID NO 99/SEQ ID NO 126/SEQ ID NO 106) | 1.8E−10 | 4.0E−08 | 7.7E−08 | 2.4E−07 | 3.1E−09 | 2.9E−10 | | A231H |
| H240-Kn138/H240-Hl147/L73-k0 (SEQ ID NO 116/SEQ ID NO 122/SEQ ID NO 106) | 3.1E−10 | 1.1E−08 | 1.3E−07 | 1.1E−07 | 2.2E−08 | 1.6E−08 | L328W | L328W |
| H240-Kn166/H240-Hl170/L73-k0 (SEQ ID NO 119/SEQ ID NO 123/SEQ ID NO 106) | 6.6E−11 | 3.1E−08 | 2.2E−08 | 2.0E−07 | 4.2E−09 | 1.0E−09 | L328A | L328A |
| H240-Kn172/H240-Hl177/L73-k0 (SEQ ID NO 120/SEQ ID NO 127/SEQ ID NO 106) | 2.5E−10 | 2.9E−08 | 5.7E−08 | 1.6E−07 | 2.0E−09 | 2.2E−10 | I332M | I332Q |
| H240-Kn149/H240-Hl068/L73-k0 (SEQ ID NO 121/SEQ ID NO 96/SEQ ID NO 106) | 3.8E−10 | 1.9E−08 | 2.6E−08 | 1.5E−07 | 1.5E−09 | 3.2E−10 | L328W, K334L | |

Furthermore, values obtained by dividing KD of H240-Kn120/H240-Hl068/L73-k0 for each of FcgRIa FcgRIIaR, FcgRIIaH, FcgRIIb, FcgRIIa F, and FcgRIIIa V by KD of each variant, the relative KD determined when taking, as 1, KD of H240-Kn120/H240-Hl068/L73-k0 for each of FcgRIIaR, FcgRIIaH, and FcgRIIb are shown in Table 61.

TABLE 61

| Sample | FcgRIa Relative KD | FcgRIIaR Relative KD | FcgRIIaH Relative KD | FcgRIIb Relative KD | FcgRIIIaF Relative KD | FcgRIIIaV Relative KD |
|---|---|---|---|---|---|---|
| H240-Kn120/H240-Hl068/L73-k0 (SEQ ID NO 99/SEQ ID NO 96/SEQ ID NO 106) | 1.0 | 1.0 | 1.0 | 1.0 | 1.0 | 1.0 |
| H240-Kn120/H240-Hl170/L73-k0 (SEQ ID NO 99/SEQ ID NO 123/SEQ ID NO 106) | 0.8 | 2.3 | 2.3 | 2.2 | 0.6 | 0.4 |
| H240-Kn120/H240-Hl150/L73-k0 (SEQ ID NO 99/SEQ ID NO 125/SEQ ID NO 106) | 0.4 | 1.0 | 1.2 | 1.5 | 0.7 | 0.6 |
| H240-Kn138/H240-Hl068/L73-k0 (SEQ ID NO 116/SEQ ID NO 96/SEQ ID NO 106) | 1.0 | 1.1 | 1.6 | 1.2 | 0.6 | 0.8 |
| H240-Kn120/H240-Hl174/L73-k0 (SEQ ID NO 99/SEQ ID NO 124/SEQ ID NO 106) | 1.1 | 0.7 | 0.7 | 1.2 | 4.3 | 10.0 |
| H240-Kn173/H240-Hl068/L73-k0 (SEQ ID NO 117/SEQ ID NO 96/SEQ ID NO 106) | 1.3 | 0.5 | 0.7 | 0.5 | 1.2 | 0.9 |
| H240-Kn178/H240-Hl068/L73-k0 (SEQ ID NO 118/SEQ ID NO 96/SEQ ID NO 106) | 0.7 | 0.8 | 0.6 | 1.4 | 1.6 | 1.9 |
| H240-Kn120/H240-Hl182/L73-k0 (SEQ ID NO 99/SEQ ID NO 126/SEQ ID NO 106) | 0.9 | 0.5 | 0.5 | 0.6 | 0.7 | 1.2 |
| H240-Kn138/H240-Hl147/L73-k0 (SEQ ID NO 116/SEQ ID NO 122/SEQ ID NO 106) | 0.5 | 1.8 | 0.3 | 1.4 | 0.1 | 0.0 |
| H240-Kn166/H240-Hl170/L73-k0 (SEQ ID NO 119/SEQ ID NO 123/SEQ ID NO 106) | 2.4 | 0.6 | 1.9 | 0.8 | 0.5 | 0.4 |
| H240-Kn172/H240-Hl177/L73-k0 (SEQ ID NO 120/SEQ ID NO 127/SEQ ID NO 106) | 0.6 | 0.7 | 0.7 | 0.9 | 1.1 | 1.6 |
| H240-Kn149/H240-Hl068/L73-k0 (SEQ ID NO 121/SEQ ID NO 96/SEQ ID NO 106) | 0.4 | 1.1 | 1.6 | 1.0 | 1.5 | 1.1 |

The variants shown in this table exhibit enhanced binding to at least one of the FcgRs of FcgRIIaR, FcgRIIaH, FcgRIIIaF, and FcgRIIIaV as compared to H240-Kn120/H240-Hl068/L73-k0.

H240-Kn120/H240-Hl170/L73-k0 resulting from introduction of L328A into H240-Hl068 that is an H chain of H240-Kn120/H240-Hl068/L73-k0 has FcgRIIaR- and FcgRIIaH-binding activities increased to 2.3 times as compared to H240-Kn120/H240-Hl068/L73-k0.

H240-Kn120/H240-Hl150/L73-k0 resulting from introduction of I332T into H240-Hl068 that is an H chain of H240-Kn120/H240-Hl068/L73-k0 has FcgRIIaH-binding activity increased by 1.2 times that of H240-Kn120/H240-Hl068/L73-k0 while retaining the FcgRIIaR-binding activity.

H240-Kn138/H240-Hl068/L73-k0 resulting from introduction of L328W into H240-Kn120 that is an H chain of H240-Kn120/H240-Hl068/L73-k0 has FcgRIIaH-binding activity increased by 1.6 times that of H240-Kn120/H240-Hl068/L73-k0 while retaining the FcgRIIaR binding activity.

H240-Kn120/H240-Hl174/L73-k0 resulting from introduction of I332E into H240-Hl068 that is an H chain of H240-Kn120/H240-Hl068/L73-k0 has FcgRIIIaF-binding activity increased by 4.3 times and FcgRIIIaV-binding activity increased to 10 times as compared to H240-Kn120/H240-Hl068/L73-k0.

H240-Kn173/H240-Hl068/L73-k0 resulting from introduction of I332Q into H240-Kn120 that is an H chain of H240-Kn120/H240-Hl068/L73-k0 has FcgRIIIaF-binding activity increased by 1.2 times that of H240-Kn120/H240-Hl068/L73-k0 while retaining the FcgRIIIaV-binding activity.

H240-Kn178/H240-Hl068/L73-k0 resulting from introduction of K334Y into H240-Kn120 that is an H chain of H240-Kn120/H240-Hl068/L73-k0 has FcgRIIIaF-binding activity increased by 1.6 times and FcgRIIIaV-binding activity increased to 1.9 times as compared to H240-Kn120/H240-Hl068/L73-k0.

H240-Kn120/H240-Hl182/L73-k0 resulting from introduction of A231H into H240-Hl068 that is an H chain of H240-Kn120/H240-Hl068/L73-k0 has FcgRIIIaV-binding activity increased by 1.2 times as compared to H240-Kn120/H240-Hl068/L73-k0.

H240-Kn138/H240-Hl147/L73-k0 resulting from introduction of L328W into both H chains of H240-Kn120/H240-Hl068/L73-k0 has FcgRIIaR-binding activity increased by 1.8 times as compared to H240-Kn120/H240-Hl068/L73-k0.

H240-Kn166/H240-Hl170/L73-k0 resulting from introduction of L328A into both H chains of H240-Kn120/H240-Hl068/L73-k0 has FcgRIIaH-binding activity increased by 1.9 times as compared to H240-Kn120/H240-Hl068/L73-k0.

H240-Kn172/H240-Hl177/L73-k0 resulting from introduction of I332M into H240-Kn120 that is an H chain of H240-Kn120/H240-Hl068/L73-k0 and introduction of I332Q into H240-Hl068 that is the other H chain has FcgRIIIaV-binding activity increased by 1.6 times that of H240-Kn120/H240-Hl068/L73-k0 while retaining the FcgRIIIaF-binding activity.

H240-Kn149/H240-Hl068/L73-k0 resulting from introduction of L328W and K334L into H240-Kn120 that is an H chain of H240-Kn120/H240-Hl068/L73-k0 has FcgRIIaH-binding activity increased to 1.6 times that of H240-Kn120/H240-Hl068/L73-k0 while retaining the binding activities to FcgRIIaR and FcgRIIIaV.

The results described above suggest that the variants have strong ADCP or ADCC activity as compared to H240-Kn120/H240-Hl068/L73-k0.

[Example 26] Preparation of Heterodimerized Antibody with Increased FcgRIIb-Binding Activity In humans, FcγRIa (CD64A), FcγRIIa (CD32A), FcγRIIb (CD32B), FcγRIIIa (CD16A), and FcγRIIIb (CD16B) have been reported as isoforms of the human FcγR protein family, and their allotypes have also been reported (Immunol Lett, 82(1-2), 57-65, 2002). FcγRIa, FcγRIIa, and FcγRIIIa have immunoactivating functions, and are called activating FcγR, while FcγRIIb has immunosuppressive functions, and is called inhibitory FcγR (Nat Rev Immunol, 10, 328-343, 2010).

FcγRIIb is the only FcγR expressed on B cells (Eur J Immunol 19, 1379-1385, 1989). Interaction of the antibody Fc region with FcγRIIb has been reported to suppress the primary immune response of B cells (J Exp Med 129, 1183-1201, 1969). Furthermore, it is reported that when FcγRIIb on B cells and a B cell receptor (BCR) are cross-linked via an immune complex in blood, B cell activation is suppressed, and antibody production by B cells is suppressed (Immunol Lett 88, 157-161, 2003). In this immunosuppressive signal transduction mediated by BCR and FcγRIIb, the immunoreceptor tyrosine-based inhibitory motif (ITIM) contained in the intracellular domain of FcγRIIb is necessary (Science, 256, 1808-1812, 1992; Nature, 368, 70-73, 1994). When ITIM is phosphorylated upon signaling, SH2-containing inositol polyphosphate 5-phosphatase (SHIP) is recruited, transduction of other activating FcγR signal cascades is inhibited, and inflammatory immune response is suppressed (Science, 290, 84-89, 2000). Furthermore, aggregation of FcgRIIb alone has been reported to transiently suppress calcium influx due to BCR cross-linking and B cell proliferation in a BCR-independent manner without inducing apoptosis of IgM-producing B cells (J Imunol, 181, 5350-5359, 2008).

Furthermore, FcγRIIb is also expressed on dendritic cells, macrophages, activated neutrophils, mast cells, and basophils. FcγRIIb inhibits the functions of activating FcγR such as phagocytosis and release of inflammatory cytokines in these cells, and suppresses inflammatory immune responses (Nat Rev Immunol, 10, 328-343, 2010).

The importance of immunosuppressive functions of FcγRIIb has been elucidated so far through studies using FcγRIIb knockout mice. There are reports that in FcγRIIb knockout mice, humoral immunity is not appropriately regulated (J Immunol, 163, 618-622, 1999), sensitivity towards collagen-induced arthritis (CIA) is increased (J Exp Med, 189, 187-194, 1999), lupus-like symptoms are presented, and Goodpasture's syndrome-like symptoms are presented (J Exp Med, 191, 899-906, 2000).

Furthermore, regulatory inadequacy of FcγRIIb has been reported to be related to human autoimmnue diseases. For example, the relationship between genetic polymorphism in the transmembrane region and promoter region of FcγRIIb, and the frequency of development of systemic lupus erythematosus (SLE) (Hum, Genet, 117, 220-227, 2005; J Biol Chem, 282, 1738-1746, 2007; Arthritis Rheum, 54, 3908-3917, 2006; Nat Med, 11, 1056-1058, 2005; J Immunol, 176, 5321-5328, 2006), and decrease of FcγRIIb expression on the surface of B cells in SLE patients (J Exp Med, 203, 2157-2164, 2006; J Immunol. 178, 3272-3280, 2007) have been reported.

From mouse models and clinical findings as such, FcγRIIb is considered to play the role of controlling autoimmune diseases and inflammatory diseases mainly through involvement with B cells, and it is a promising target molecule for controlling autoimmune diseases and inflammatory diseases.

IgG1, mainly used as a commercially available antibody pharmaceutical, is known to bind not only to FcγRIIb, but also strongly to activating FcγR (Blood, 113, 3716-3725, 2009). It may be possible to develop antibody pharmaceuticals having greater immunosuppressive properties compared with those of IgG1, by utilizing an Fc region with enhanced FcγRIIb binding, or improved FcγRIIb-binding activity selectivity compared with activating FcγR. For example, it has been suggested that the use of an antibody having a variable region that binds to BCR and an Fc with enhanced FcγRIIb binding may inhibit B cell activation (Mol Immunol, 45, 3926-3933, 2008). It has been reported that crosslinking FcγRIIb on B cells and IgE bound to a B-cell receptor suppresses differentiation of B cells into plasma cells, which as a result causes suppression of IgE production; and in human PBMC-transplanted mice, human IgG and IgM concentrations are maintained whereas the human IgE concentration is decreased (Acad News, doi: 10.1016, jaci.2011.11.029). Besides IgE, it has been reported that when FcgRIIB and CD79b forming a B-cell receptor complex are cross-linked by an antibody, B cell proliferation is suppressed in vitro, and symptoms are alleviated in the collagen arthritis model (Arthritis Rheum, 62, 1933-1943, 2010).

Besides B cells, it has been reported that crosslinking of FcεRI and FcgRIIb on mast cells using molecules, in which the Fc portion of an IgG with enhanced FcgRIIb binding is fused to the Fc portion of IgE that binds to an IgE receptor FcεRI, causes FcgRIIb phosphorylation, thereby suppressing FcεRI-dependent calcium influx. This suggests that inhibition of degranulation via FcgRIIb stimulation is possible by enhancing FcgRIIb binding (Immunol let, doi: 10.1016/j.imlet.2012.01.008).

Accordingly, an antibody having an Fc with improved FcγRIIb-binding activity is suggested to be promising as a therapeutic agent for inflammatory diseases such as autoimmune diseases.

Furthermore, mutants with enhanced FcgRIIb binding have been suggested to be promising therapeutic agents for cancer, as well as therapeutic agents for inflammatory diseases such as autoimmune diseases. So far, FcgRIIb has been found to play an important role in the agonistic activity of agonist antibodies against the anti-TNF receptor family. Specifically, it has been suggested that interaction with FcgRIIb is required for the agonistic activity of antibodies against CD40, DR4, DR5, CD30, and CD137, which are included in the TNF receptor family (Science, 333, 1030-1034, 2011; Cancer Cell 19, 101-1113, 2011; J Clin Invest 2012, doi:10.1172/JCI61226; J Immunol 171, 562-, 2003; Blood, 108, 705-, 2006; J Immunol 166, 4891, 2001). Non-patent Document (Science, 333, 1030-1034, 2011) shows that the use of antibodies with enhanced FcgRIIb binding enhances the anti-tumor effect of anti-CD40 antibodies. Accordingly, antibodies with enhanced FcgRIIb are expected to have an effect of enhancing agonistic activity of agonist antibodies including antibodies against the anti-TNF receptor family.

Antibodies having an Fc with improved FcγRIIb-binding activity have been reported (Mol Immunol, 45, 3926-3933, 2008). In this Document, FcγRIIb-binding activity was improved by adding alterations such as S267E/L328F, G236D/S267E, and S239D/S267E to an antibody Fc region. In the document, the antibody introduced with the S267E/L328F mutation most strongly binds to FcγRIIb. Therefore, by further enhancing FcγRIIb binding, it is expected that the above-described function mediated by FcγRIIb can be enhanced.

Furthermore, antibodies introducing S267E/L328E mutation maintains the same level of binding to FcγRIa and FcγRIIa type H as that of a naturally-occurring IgG1. However, another report shows that this alteration enhances the binding to type-R FcγRIIa several hundred times to the same level of FcγRIIb binding, which means the FcγRIIb-binding activity selectivity is not improved in comparison with type-R FcγRIIa (Eur J Immunol 23, 1098-1104, 1993).

Even if FcγRIIb binding had been enhanced compared with that of IgG1, only the effect of enhancing FcγRIIa binding and not the enhancement of FcγRIIb binding is considered to have influence on cells such as platelets which express FcγRIIa but do not express FcγRIIb (Nat Rev Immunol, 10, 328-343, 2010). For example, the group of patients who were administered bevacizumab, an antibody against VEGF, is known to have an increased risk for thromboembolism (J Natl Cancer Inst, 99, 1232-1239, 2007). Furthermore, thromboembolism has been observed in a similar manner in clinical development tests of antibodies against the CD40 ligand, and the clinical study was discontinued (Arthritis Rheum, 48, 719-727, 2003). In both cases of these antibodies, later studies using animal models and such have suggested that the administered antibodies aggregate platelets via FcgRIIa binding on the platelets, and form blood clots (J Thromb Haemost, 7, 171-181, 2008; J Immunol, 185, 1577-1583, 2010). In systemic lupus erythematosus which is an autoimmune disease, platelets are activated via an FcγRIIa-dependent mechanism, and platelet activation has been reported to correlate with the severity of symptoms (Sci Transl Med, vol 2, issue 47, 47-63, 2010). Even if FcgRIIb binding is enhanced, administering an antibody with enhanced FcgRIIa binding to such patients who already have a high risk for developing thromboembolism will increase the risk for developing thromboembolism, thus is extremely dangerous.

Furthermore, antibodies with enhanced FcgRIIa binding have been reported to enhance macrophage-mediated antibody dependent cellular phagocytosis (ADCP) (Mol Cancer Ther 7, 2517-2527, 2008). When antibody's antigens are phagocytized by macrophages, antibodies themselves are also phagocytized at the same time. In that case, peptide fragments derived from those antibodies are also presented as an antigen and the antigenicity may become higher, thereby increasing the risk of production of antibodies against antibodies (anti-antibodies). More specifically, enhancing FcgRIIa binding will increase the risk of production of antibodies against the antibodies, and this will remarkably decrease their value as pharmaceuticals.

More specifically, the value as pharmaceuticals will be considerably reduced when FcgRIIa binding is enhanced, which leads to increased risk of thrombus formation via platelet aggregation, higher antigenicity, and increased risk of anti-antibody production.

From such a viewpoint, the aforementioned Fc with enhanced FcgRIIb binding shows remarkably enhanced type-R FcgRIIa binding compared with that of a naturally-occurring IgG1. Therefore, its value as a pharmaceutical for patients carrying type-R FcgRIIa is considerably reduced. Types H and R of FcγRIIa are observed in Caucasians and African-Americans with approximately the same frequency (J Clin Invest, 97, 1348-1354, 1996; Arthritis Rheum, 41, 1181-1189, 1998). Therefore, when this Fc was used for treatment of autoimmune diseases, the number of patients who can safely use it while enjoying its effects as a pharmaceutical will be limited.

Furthermore, in dendritic cells deficient in FcgRIIb or dendritic cells in which the interaction between FcgRIIb and the antibody Fc portion is inhibited by an anti-FcgRIIb antibody, dendritic cells have been reported to mature spontaneously (J Clin Invest 115, 2914-2923, 2005; Proc Natl Acad Sci USA, 102, 2910-2915, 2005). This report suggests that FcgRIIb is actively suppressing maturation of dendritic cells in a steady state where inflammation and such are not taking place. FcgRIIa is expressed on the dendritic cell surface in addition to FcgRIIb; therefore, even if binding to inhibitory FcgRIIb is enhanced and if binding to activating FcgR such as FcgRIIa is also enhanced, maturation of dendritic cells may be promoted as a result. More specifically, improving not only the FcgRIIb-binding activity but also the ratio of FcgRIIb-binding activity relative to FcgRIIa-binding activity is considered to be important in providing antibodies with an immunosuppressive action.

Therefore, when considering generation of pharmaceuticals that utilize the FcgRIIb binding-mediated immunosuppressive action, there is a need for an Fc that not only has enhanced FcgRIIb-binding activity, but also has binding to both FcgRIIa, types H and R allotypes, which is maintained at a similar level or is weakened to a lower level than that of a naturally-occurring IgG1.

Meanwhile, cases where amino acid alterations were introduced into the Fc region to increase the FcγRIIb-binding activity selectivity have been reported so far (Mol Immunol, 40, 585-593, 2003). However, all variants said to have improved FcγRIIb selectivity as reported in this document showed decreased FcγRIIb binding compared with that of a naturally-occurring IgG1. Therefore, it is considered to be difficult for these variants to actually induce an FcγRIIb-mediated immunosuppressive reaction more strongly than IgG1.

Furthermore, since FcgRIIb plays an important role in the agonist antibodies mentioned above, enhancing their binding activity is expected to enhance the agonistic activity. However, when FcgRIIa binding is similarly enhanced, unintended activities such as ADCC activity and ADCP activity will be exhibited, and this may cause side effects. Also from such viewpoint, it is preferable to be able to selectively enhance FcgRIIb-binding activity.

From these results, in producing antibody pharmaceuticals to be used for treating autoimmune diseases and cancer utilizing FcγRIIb, it is important that compared with those of a naturally-occurring IgG, the activities of binding to both FcγRIIa allotypes are maintained or decreased, and FcγRIIb binding is enhanced. However, FcγRIIb shares 93% sequence identity in the extracellular region with that of FcγRIIa which is one of the activating FcγRs, and they are very similar structurally. There are allotypes of FcγRIIa, H type and R type, in which the amino acid at position 131 is His (type H) or Arg (type R), and yet each of them reacts differently with the antibodies (J Exp Med, 172, 19-25, 1990). Therefore, to produce an Fc region that selectively binds to FcγRIIb, the most difficult problem may be conferring to the antibody Fc region with the property of selectively improved FcγRIIb-binding activity, which involves distinguishing these homologous sequences, and decreasing or not increasing the binding activity towards each allotype of FcγRIIa, while increasing the binding activity towards FcγRIIb. So far, variants having sufficient FcgRIIb selectivity have not been obtained. US 2009/0136485 reports variants with enhanced FcγRIIb-binding activity; however, the degree of enhancement is low, and there is a demand for development of variants having properties similar to those described above.

In this assessment, the present inventors investigated the preparation of variants whose binding activity has been increased in an FcgRIIb-selective manner using heterodimerized antibodies. Variable region IL6R (SEQ ID NO: 128), which is the variable region of an antibody against human interleukin 6 receptor disclosed in WO 2009/125825, was used as the variable region of antibody H chain. Furthermore, IL6R-G1d (SEQ ID NO: 129) containing G1d that lacks the C-terminal Gly and Lys of human IgG1 was produced, and then K439E was introduced into IL6R-G1d to construct IL6R-B3 (SEQ ID NO: 130). Meanwhile, E233D, G237D, P238D, H268D, P271G, and A330R were introduced into IL6R-B3 to construct IL6R-BP208 (SEQ ID NO: 131). In addition, S267E and L328F were introduced into IL6R-B3 to construct IL6R-BP253 (SEQ ID NO: 132) having an existing Fc with increased FcgRIIb-binding activity. The L chain of tocilizumab, IL6R-L (SEQ ID NO: 133), was used as the common antibody L chain, and were used in combination with each H chain according to the method described in Reference Example 1 to produce homodimers IL6R-B3/IL6R-L, IL6R-BP208/IL6R-L, and IL6R-BP253/IL6R-L. These variants were assessed for the binding activity to FcgR Ia, FcgR IIaR, FcgR IIaH, FcgR IIb, and FcgR IIIaV according to the method described in Reference Example 8. The results are shown in Table 62. When a cell is filled with gray in Table 62, it means that the binding of FcgR to IgG was The binding of FcgRIIaH and FcgRIIIaV to IL6R-BP208/IL6R-L and the binding of FcgRIIIaV to IL6R-BP253/IL6R-L were concluded to be too weak to properly analyze by kinetic analysis. Thus, when the interaction between each of the altered antibodies and FcgR was weak, and correct analysis was determined to be impossible by the above-mentioned kinetic analysis, the KD for such interactions were calculated (and the calculated KD shown in Table 62) using the following 1:1 binding model equation described in the Biacore T100 Software Handbook BR1006-48 Edition AE.

The behavior of interacting molecules according to the 1:1 binding model on Biacore can be described by Equation 1 shown below.

$$R_{eq} = C \cdot R_{max}/(KD+C) + RI \qquad \text{[Equation 1]}$$

$R_{eq}$: a plot of steady state binding levels against analyte concentration

C: concentration

RI: bulk refractive index contribution in the sample $R_{max}$: analyte binding capacity of the surface When this equation is rearranged, KD can be expressed as Equation 2 shown below.

$$KD = C \cdot R_{max}/(R_{eq}-RI) - C \qquad \text{[Equation 2]}$$

KD can be calculated by substituting the values of $R_{max}$, RI, and C into this equation. The values of RI and C can be determined from the sensorgram of the measurement results and measurement conditions. $R_{max}$ was calculated according to the following method. As a target of comparison, for antibodies that had sufficiently strong interactions as evaluated simultaneously in the same round of measurement, the $R_{max}$ value was obtained through global fitting using the 1:1 Langmuir binding model, and then it was divided by the amount of the comparison antibody captured onto the sensor chip, and multiplied by the captured amount of an altered antibody to be evaluated.

| sample | FcgRIa KD (M) | FcgRIIaR KD (M) | FcgRIIaH KD (M) | FcgRIIb KD (M) | FcgRIIIaF KD (M) |
|---|---|---|---|---|---|
| G1d | 3.2E−10 | 1.0E−06 | 6.7E−07 | 2.6E−06 | 3.5E−07 |
| IL6R-B3/IL6R-L | 4.2E−10 | 1.1E−06 | 7.7E−07 | 3.1E−06 | 3.3E−07 |
| IL6R-BP253/IL6R-L | 5.0E−11 | 2.3E−09 | 8.6E−07 | 8.9E−09 | 7.1E−06 |
| IL6R-BP208/IL6R-L | 1.9E−08 | 8.5E−07 | 8.3E−06 | 3.2E−08 | 5.3E−05 |

Values obtained by dividing KD of IL6R-B3/IL6R-L for each of FcgRIa FcgRIIaR, FcgRIIaH, and FcgRIIb by the corresponding KD of each modified variant, the relative KD determined when taking, as 1, KD of IL6R-B3/IL6R-L for FcgRIIaR, FcgRIIaH, or FcgRIIb are shown in Table 63.

TABLE 63

| sample | FcgRIIaR Relative KD | FcgRIIaH Relative KD | FcgRIIb Relative KD |
| --- | --- | --- | --- |
| IL6R-B3/IL6R-L | 1.0 | 1.0 | 1.0 |
| IL6R-BP253/IL6R-L | 480.0 | 0.9 | 349.2 |
| IL6R-BP208/IL6R-L | 1.3 | 0.1 | 95.4 |

As shown in Table 63, IL6R-BP253/IL6R-L, which is an existing antibody with increased FcgRIIb-binding activity, has FcgRIIb-binding activity increased to about 350 times and FcgRIIaR-binding activity increased to about 500 times as compared to human IgG1 antibody (IL6R-B3/IL6R-L) without introduction of the alteration. Meanwhile, the FcgRIIb-binding activity of IL6R-BP208/IL6R-L is about 100 times and thus inferior to the existing antibody with increased FcgRIIb-binding activity; however, its FcgRIIaR-binding activity is 1.3 times and comparable to that of the IgG1 type. Thus, IL6R-BP208/IL6R-L is an antibody excellent in selectivity for FcgRIIb.

Next, the present inventors considered that, for the purpose of improving the FcgR2b-binding activity and the selectivity, it is necessary to obtain information on the crystallographic structure of the complex between FcgRIIb extracellular region and Fc (BP208), which is the Fc of IL6R-BP208/IL6R-L, and to more precisely assess amino acid mutations to be introduced. Thus, the complex between Fc (BP208) and FcgRIIb extracellular region was analyzed by X-ray crystallography according to the experimental method described below.

[Expression and Purification of Fc (BP208)]

An Fc (BP208) was prepared as follows. First, Cys at position 220 (EU numbering) of IL6R-BP208 was substituted with Ser. Then, genetic sequence of Fc (BP208) from Glu at position 236 (EU numbering) to its C terminal was cloned by PCR. Using this cloned genetic sequence, production of expression vectors, and expression and purification of Fc (BP208) were carried out according to the method of Reference Example 1. Cys at position 220 (EU numbering) forms a disulfide bond with Cys of the L chain in general IgG1. The L chain is not co-expressed when Fc alone is prepared, and therefore, this residue was substituted with Ser to avoid formation of unnecessary disulfide bonds.

[Expression and Purification of the FcgRIIb Extracellular Region]

This was prepared according to the method of Reference Example 8.

[Purification of the Fc (BP208)/FcgRIIb Extracellular Region Complex]

To 1.5 mg of the FcgRIIb extracellular region sample obtained for crystallization, 0.15 mg of Endo F1 (Protein Science 1996, 5: 2617-2622) expressed and purified from *Escherichia coli* as a glutathione S-transferase fusion protein was added. This was allowed to remain at room temperature for three days in 0.1 M Bis-Tris buffer at pH 6.5, and the N-linked oligosaccharide was cleaved, leaving N-acetylglucosamine directly bound to Asn. Next, this FcgRIIb extracellular region sample subjected to carbohydrate cleavage treatment was concentrated by ultrafiltration with 5000 MWCO, and purified by gel filtration chromatography (Superdex200 10/300) using a column equilibrated in 20 mM HEPES at pH 7.5 containing 0.1 M NaCl. Furthermore, to the obtained carbohydrate-cleaved FcgRIIb extracellular region fraction, Fc(BP208) was added so that the molar ratio of the FcgRIIb extracellular region would be present in slight excess, and after concentration by ultrafiltration with 10,000 MWCO, a sample of the Fc (BP208)/FcgRIIb extracellular region complex was obtained through purification by gel filtration chromatography (Superdex200 10/300) using a column equilibrated in 25 mM HEPES at pH 7.5 containing 0.1 M NaCl.

[Crystallization of the Fc (BP208)/FcgRIIb Extracellular Region Complex]

A sample of Fc (BP208)/FcgRIIb extracellular region complex were concentrated to about 10 mg/ml using 10000MWCO ultrafiltration filter, and crystallized using the hanging drop vapor diffusion method in combination with the seeding method. VDXm plate (Hampton Research) was used for crystallization. Using a reservoir solution containing 0.1 M Bis-Tris (pH 6.5), 19% PEG3350, and 0.2 M potassium phosphate dibasic, crystallization drops were prepared at a mixing ratio of reservoir solution:crystallization sample=0.85 µl:0.85 µl. Crystals of the complex obtained under the same condition were crushed with Seed Bead (Hampton Research) to prepare a seed crystal solution. 0.15 µl of a diluted solution produced from the seed crystal solution was added to the crystallization drops, which were sealed in the wells containing reservoirs, and allowed to stand at 20° C. This successfully yielded plate-like crystals.

[Measurement of X-Ray Diffraction Data from an Fc (BP208)/FcgRIIb Extracellular Region Complex Crystal]

One of the obtained single crystals of the Fc (BP208)/FcgRIIb extracellular region complex was soaked into a solution of 0.1 M Bis-Tris pH 6.5, 24% PEG3350, 0.2 M potassium phosphate dibasic, ethlene glycol 20% (v/v). The crystal was fished out of the solution using a pin with attached tiny nylon loop, and frozen in liquid nitrogen; and then X-ray diffraction data was measured by BL32XUin Spring-8. During the measurement, the crystal was constantly placed in a nitrogen stream at −178° C. to maintain in a frozen state, and a total of 300 X ray diffraction images were collected using MX-225HE CCD detector (RAYONIX) attached to a beam line with rotating the crystal 0.6° at a time. Determination of cell parameters, indexing of diffraction spots, and diffraction data processing from the obtained diffraction images were performed using the Xia2 program (J. Appl. Cryst. 2010, 43: 186-190), XDS Package (Acta. Cryst. 2010, D66: 125-132) and Scala (Acta. Cryst. 2006, D62: 72-82); and finally, diffraction intensity data up to 2.81 Å resolution was obtained. The crystal belongs to the space group C222$_1$, and has the following cell parameters; a=156.69 Å, b=260.17 Å, c=56.85 Å, α=90°, β=90°, γ=90°.

[X Ray Crystallographic Analysis of the Fc (BP208)/FcgRIIb Extracellular Region Complex]

Crystal structure of the Fc (BP208)/FcγRIIb extracellular region complex was determined by the molecular replacement method using the program Phaser ((J. Appl. Cryst. 2007, 40: 658-674). From the size of the obtained crystal lattice and the molecular weight of the Fc (BP208)/FcgRIIb extracellular region complex, the number of complexes in the asymmetric unit was predicted to be one. From the structural coordinates of PDB code: 3SGJ which is the crystal structure of the Fc(WT)/FcgRIIIa extracellular region complex, the amino acid residue portions of the A chain positions 239-340 and the B chain positions 239-340 were taken out as separate coordinates, and they were used respectively as models for searching the Fc CH2 domains. The amino acid residue portions of the A chain positions 341-444 and the B chain positions 341-443 were taken out as a single set of coordinates from the same structural coordinates of PDB code: 3SGJ; and this was used as a model for searching the Fc CH3 domains. Finally, from the structural coordinates of PDB code: 2FCB which is a crystal structure of the FcgRIIb extracellular region, the amino acid residue portions of the A chain positions 6-178 was taken out and used as a model for searching the Fc (BP208). The present inventors tried to determine the orientations and positions of each search model of Fc CH3 domains, FcgRIIb extracellular region, and Fc CH2 domain in the crystal lattices using rotation function and translation function, but failed to determine the position of one of the CH2 domains. Then, with reference to the crystal structure of the complex of Fc (WT)/FcgRIIIa extracellular region, the position of the last CH2 domain A was determined from an electron density map that was calculated based on the phase determined from the remaining three parts. Thus, the present inventors obtained an initial model for the crystal structure of the Fc (BP208)/FcgRIIb extracellular region complex. When rigid body refinement which moves the two Fc CH2 domains, the two Fc CH3 domains, and the FcgRIIb extracellular region was performed on the obtained initial model, the crystallographic reliability factor, R value became 42.6%, and the Free R value became 43.7% to diffraction intensity data from 25 Å to 3.0 Å at this point. Furthermore, structural refinement using the program REFMACS (Acta Cryst. 2011, D67, 355-367), and revision of the model to observe the electron density maps whose coefficient have 2Fo-Fc or Fo-Fc, which are calculated based on the experimentally determined structural factor Fo, the calculated structural factor Fc and the calculated phase using the model, was carried out by the Coot program (Acta Cryst. 2010, D66: 486-501), and model refinement was carried out by repeating these steps. Finally, as a result of incorporation of water molecules into the model based on the electron density maps which use 2Fo-Fc or Fo-Fc as the coefficient, and the following refinement, the crystallographic reliability factor, R values and the Free R value of the model containing 4794 non-hydrogen atoms became 24.4% and 27.9% to 27259 diffraction intensity data from 25 Å to 2.81 Å resolution, respectively.

The three-dimensional structure of the complex of Fc (BP208)/FcgRIIb extracellular region was determined at 2.81 Å resolution by the structure analysis. The structure obtained as a result of the analysis is shown in FIG. 49. FcgRIIb extracellular region was revealed to be bound and sandwiched between two Fc CH2 domains, which resembles the three-dimensional structures of the previously analyzed complexes between Fc (WT), which is Fc of native IgG, and the respective extracellular regions of FcgRIIIa (Proc. Natl. Acad. Sci. USA, 2011, 108, 12669-126674), FcgRIIIb (Nature, 2000, 400, 267-273; J. Biol. Chem. 2011, 276, 16469-16477), and FcgRIIa.

However, a detailed observation of Fc (BP208) revealed an alteration in the loop structure at 233-239 following the hinge region in CH2 domain A due to an influence of the introduced mutations G237D and P238D as compared to Fc (WT) bound to FcgRIIa (FIG. 50). The result showed that the main chain amide of G237 in Fc (BP208) formed a strong hydrogen bond with the side chain of Tyr160 in FcgRIIb. In FcgRIIa, Phe is present instead of this Tyr160, and is incapable of forming such a hydrogen bond. This suggests that the above described hydrogen bond has important contribution to the acquisition of the selectivity, i.e., improvement of the FcgRIIb-binding activity and reduction of the FcgRIIa binding.

Based on the results of the structural analysis, the present inventors precisely assessed possible alterations to further increase the activity, and found S239 as a candidate for the alteration introduction site. As shown in FIG. 51, Ser239 of CH2 domain B is located at a position toward which Lys117 of FcgRIIb protrudes in a structurally natural fashion. However, since the electron density was not observed for Lys117 of FcgRIIb by the analysis described above, it is thought that Lys117 does not take a definite structure and has only a limited effect on the interaction with Fc (BP208) in the current situation. When S239 of CH2 domain B is altered to negatively charged D or E, an electrostatic interaction with positively charged Lys117 of FcgRIIb can be expected, thereby resulting in improved FcgRII-binding activity.

On the other hand, an observation of the structure of S239 in CH2 domain A suggests that the side chain of this amino acid, by forming a hydrogen bond to the main chain of G236, stabilizes the loop structure at positions 233 to 239, including D237 which forms a hydrogen bond with the side chain of FcgRIIb Tyr160, following the hinge region (FIG. 52). The stabilization of the loop structure in the binding conformation suppresses the entropy reduction upon binding, and results in an increase in the binding free energy, leading to the improvement of the binding activity. Meanwhile, when S239 of CH2 domain A is altered to D or E, the loop structure becomes unstable due to loss of the hydrogen bond with the main chain of G236. In addition, electrostatic repulsion to D265 in close proximity may be caused, leading to further destabilization of the loop structure. The energy for the destabilization works to decrease the FcgRIIb-interaction energy, resulting in reduced binding activity. Specifically, in the case of a homodimerized antibody both of whose H chains have been introduced with S239D or S239E, the binding activity-enhancing effect due to the electrostatic interaction of CH2 domain B to Lys117 of FcgRIIb is counterbalanced by the binding activity-reducing effect due to destabilization of the loop structure in CH2 domain A, and thus may not result in enhancement of the binding activity. On the other hand, in the case of a heterodimerized antibody only one of whose H chains has been introduced with S239D or S239E, since the loop structure stabilization by 5239 of CH2 domain A is maintained, the binding activity was thought to increase corresponding to the newly formed electrostatic interaction with Lys117 of FcgRIIb due to S239D or S239E introduced into CH2 domain B.

In order to assess the above-described hypothesis, the present inventors tried to produce antibodies with further increased FcgRIIb-binding activity by introducing mutation S239D or S239E into the Fc region of one H chain alone using IL6R-BP208/IL6R-L as a template. IL6R-BP256 (SEQ ID NO: 134) resulting from introduction of S239D into IL6R-BP208, and IL6R-BP257 (SEQ ID NO: 135) resulting from introduction of S239E into IL6R-BP208 were produced as an antibody H chain. Furthermore, IL6R-A5 (SEQ ID NO: 136) resulting from introduction of mutations D356K and H435R into IL6R-G1d, and IL6R-AP002 (SEQ ID NO: 137) resulting from introduction of E233D, G237D, P238D, H268D, P271G, and A330R into IL6R-A5 (SEQ ID NO: 136) were produced as the other H chain. IL6R-L (SEQ ID NO: 133) which is the L chain from tocilizumab was used as the common antibody L chain, and the homodimerized antibodies IL6R-B3/IL6R-L, IL6R-BP208/IL6R-L, IL6R-BP253/IL6R-L, IL6R-BP256/IL6R-L, and IL6R-BP257/IL6R-L, and the heterodimerized antibodies IL6R-AP002/IL6R-BP256/IL6R-L, and IL6R-AP002/IL6R-BP257/IL6R-L were prepared together with the respective H chains according to the method described in Reference Example 1. The variants were assessed for the binding activity to FcgR Ia, FcgR IIaR, FcgR IIaH, and FcgRIIb according to the method described in Reference Example 8. The results are shown in Table 64.

TABLE 64

| sample | FcgRIa KD (M) | FcgRIIaR KD (M) | FcgRIIaH KD (M) | FcgRIIb KD (M) | FcgRIIIaV KD (M) |
|---|---|---|---|---|---|
| IL6R-B3/IL6R-L | 4.2E−10 | 1.1E−06 | 7.7E−07 | 3.1E−06 | 3.3E−07 |
| IL6R-BP253/IL6R-L | 5.0E−11 | 2.3E−09 | 8.6E−07 | 8.9E−09 | 4.0E−07 |
| IL6R-BP208/IL6R-L | 1.9E−08 | 8.5E−07 | 8.3E−06 | 3.2E−08 | 5.3E−05 |
| IL6R-BP256/1L6R-L | 2.0E−09 | 7.3E−07 | 2.1E−05 | 8.7E−08 | 1.1E−05 |
| IL6R-BP257/IL6R-L | 3.1E−10 | 1.3E−06 | 3.9E−05 | 4.3E−07 | 1.9E−05 |
| IL6R-AP002/IL6R-BP256/IL6R-L | 3.6E−09 | 1.4E−07 | 4.2E−06 | 4.1E−09 | 1.7E−05 |
| IL6R-AP002/IL6R-BP257/IL6R-L | 1.9E−09 | 1.3E−07 | 4.9E−06 | 4.7E−09 | 1.4E−05 |

The binding of FcgRIIaH to IL6R-BP208/IL6R-L, IL6R-BP256/IL6R-L, and IL6R-BP257/IL6R-L and the binding of FcgRIIIaV to IL6R-BP208/IL6R-L, IL6R-BP256/IL6R-L, IL6R-BP257/IL6R-L, IL6R-AP002/IL6R-BP256/IL6R-L, and IL6R-AP002/IL6R-BP257/IL6R-L were concluded to be too weak to properly analyze by kinetic analysis. Thus, when the interaction between each of the altered antibodies and FcgR was weak, and correct analysis was determined to be impossible by the above-mentioned kinetic analysis, the KD for such interactions were calculated (and the calculated KD shown in Table 64) using the following 1:1 binding model equation described in the Biacore T100 Software Handbook BR1006-48 Edition AE.

The behavior of interacting molecules according to the 1:1 binding model on Biacore can be described by Equation 1 shown below.

$$R_{eq} = C \cdot R_{max}/(KD+C)+RI \quad \text{[Equation 1]}$$

$R_{eq}$: a plot of steady state binding levels against analyte concentration
C: concentration
RI: bulk refractive index contribution in the sample
$R_{max}$: analyte binding capacity of the surface When this equation is rearranged, KD can be expressed as Equation 2 shown below.

$$KD = C \cdot R_{max}/(R_{eq}-RI)-C \quad \text{[Equation 2]}$$

KD can be calculated by substituting the values of $R_{max}$, RI, and C into this equation. The values of RI and C can be determined from the sensorgram of the measurement results and measurement conditions. $R_{max}$ was calculated according to the following method. As a target of comparison, for antibodies that had sufficiently strong interactions as evaluated simultaneously in the same round of measurement, the $R_{max}$ value was obtained through global fitting using the 1:1 Langmuir binding model, and then it was divided by the amount of the comparison antibody captured onto the sensor chip, and multiplied by the captured amount of an altered antibody to be evaluated.

Meanwhile, values obtained by dividing KD of IL6R-B3/IL6R-L for each of FcgRIa FcgRIIaR, FcgRIIaH, and FcgRIIb by KD of each variant, the relative KD determined when taking, as 1, KD of IL6R-B3/IL6R-L for each of FcgRIIaR, FcgRIIaH, and FcgRIIb, and values obtained by dividing KD of each variant for FcgRIIaR by KD for FcgRIIb are shown in Table 65.

TABLE 65

| sample | FcgRIIaR Relative KD | FcgRIIaH Relative KD | FcgRIIb Relative KD | KD(IIaR)/ KD(IIb) |
|---|---|---|---|---|
| IL6R-B3/IL6R-L | 1.0 | 1.0 | 1.0 | 0.3 |
| IL6R-BP253/IL6R-L | 480.0 | 0.9 | 349.2 | 0.3 |
| IL6R-BP208/IL6R-L | 1.3 | 0.1 | 95.4 | 26.3 |
| IL6R-BP256/IL6R-L | 1.5 | 0.0 | 35.7 | 8.4 |
| IL6R-BP257/IL6R-L | 0.9 | 0.0 | 7.2 | 3.0 |
| IL6R-AP002/IL6R-BP256/IL6R-L | 7.7 | 0.2 | 751.8 | 34.3 |
| IL6R-AP002/IL6R-BP257/IL6R-L | 8.3 | 0.2 | 657.4 | 27.7 |

As shown in Table 65, IL6R-BP256/IL6R-L and IL6R-BP257/IL6R-L resulting from introduction of S239D or S239E into both H chains of IL6R-BP208/IL6R-L exhibited reduced FcgRIIb-binding activity as well as reduced FcgRIIaR-binding activity as compared to the variant IL6R-BP208/IL6R-L before introduction. Meanwhile, the binding to FcgRIIb of IL6R-AP002/IL6R-BP256/IL6R-L and IL6R-AP002/IL6R-BP257/IL6R-L resulting from introduction of S239D or S239E into one H chain of IL6R-BP208/IL6R-L was increased by 752 times and 657 times, respectively, and thus their FcgRIIb-binding activities were higher than that achieved by the existing technique. Furthermore, the FcgRIIaR-binding activities were increased to 7.7 times and 8.3 times, respectively, while that of IL6R-BP208/IL6R-L was increased to 1.3 times. In the table, KD(IIaR)/KD(IIb) represents a value obtained by dividing KD of each variant for FcgRIIaR by KD for FcgRIIb. When the value is larger, it means that the selectivity for FcgRIIb is higher. The value for IL6R-BP253/IL6R-L which is an existing antibody with increased FcgRIIb-binding activity is 0.3, suggesting that the selectivity has not been improved as compared to IgG1 type, while the value for IL6R-BP208/IL6R-L is 26.3, implying that it has high FcgRIIb selectivity. In this experiment, IL6R-AP002/IL6R-BP256/IL6R-L and IL6R-AP002/IL6R-BP257/IL6R-L, resulting from introduction of S239D or S239E into one H chain of IL6R-BP208/IL6R-L, showed KD(IIaR)/KD(IIb) values of 34.3 and 27.7, respectively, and were improved more than IL6R-BP208/IL6R-L.

The result of comprehensive assessment of variants using IgG1 type (GpH7-B3/GpL16-k0) as a template, which was carried out as described in Example 4, shows that S239D and S239E have effects as shown in Table 66. In the table, Ho/Con_2 aR and Ho/Con_2 b represent the FcgRIIaR- and FcgRIIb-binding activity levels when taking as 100 those of the control homodimerized antibody. Meanwhile, He/Con_2 aR and He/Con_2 b represent the FcgRIIaR- and FcgRIIb-binding levels when taking as 100 those of the control heterodimerized antibody.

TABLE 66

| ALTERATION | Ho/Con_2aR | Ho/Con_2b | He/Con_2aR | He/Con_2b |
|---|---|---|---|---|
| S239D | 137 | 223 | 129 | 209 |
| S239E | 117 | 174 | 127 | 183 |

Table 66 shows that alterations S239D and S239E introduced in this experiment, when introduced into native IgG1 regardless of either or both chains, enhanced the binding to FcRIIaR and FcgRIIb. However, the alterations, when introduced into both H chains of IL6R-BP208/IL6R-L, reduced the binding activities to FcgRIIaR and FcgRIIb, and only when introduced into one H chain, increased the binding activities to FcgRIIaR and FcgRIIb. The result demonstrates that the effect of the alterations is different from that obtained using the IgG1 type as a template. Thus, these alterations were demonstrated to achieve the above-described effect only when introduced into IL6R-BP208/IL6R-L.

[Example 27] Design of the Amino Acid Sequence of Constant Region to Improve the Capacity to Separate and Purify Homodimers and Heterodimers

[Selection of Residue Substitution Site]

Co-expression of two types of H chains (referred to as A chain and B chain) in manufacturing heterodimerized antibodies results in formation of: homodimerized antibody resulting from dimerization of H chains both of which are A chains, homodimerized antibody resulting from dimerization of H chains both of which are B chains, and heterodimerized antibody resulting from dimerization of H chains one of which is A chain and the other is B chain. A known method for efficiently separating and purifying heterodimerized antibodies of interest is to control the isoelectric point of an antibody and the capacity of retention and separation in an ion-exchange column by substituting amino acid residues in each variable region (WO 2007/114325). However, since each antibody has a different sequence in its variable regions, particularly in the CDR region, the method described above has limited versatility. Then, as a more versatile method for substituting residues in antibodies to purify heterodimerized antibodies, the present inventors investigated a method for controlling the isoelectric point and the capacity of retention and separation in an ion-exchange column by substituting residues only in the constant region of an antibody.

In general, the separation in an ion-exchange column is thought to depend on electric charges on the surface of molecules, and in many cases the separation condition is examined by considering the isoelectric point of a target molecule. Thus, in this Example, the separation in an ion-exchange column was also expected to be improved by substituting amino acid residues that constitute the antibody constant region in a way that causes an electric point difference between homodimerized antibodies and heterodimerized antibodies to be separated.

Meanwhile, not only a pure ion-exchange mode but also hydrophobic interaction has been suggested to be involved in the separation by ion-exchange chromatography (Peng Liu et al., J Chromatogr A. 2009 Oct. 30; 1216(44): 7497-7504). For this reason, in the separation and purification based on the method described above, it is possible to use hydrophobic chromatography in addition to ion-exchange chromatography.

Residue substitution methods for altering the isoelectric point include methods for substituting a neutral residue with a basic or acidic residue and methods for substituting a basic or acidic residue with a neutral residue. More effective approaches include methods for substituting a positively charged residue with a negatively charged residue and methods for substituting a negatively charged residue with a positively charged residue.

In the methods described above, every part of an antibody sequence can be a candidate for the substitution site of a residue that results in an isoelectric point change. However, random substitution that gives rise to a non-native sequence can increase the risk of immunogenicity, and is not an appropriate method from the viewpoint of pharmaceutical use.

Residues can be substituted so as to minimize the number of T-cell epitopes involved in immunogenicity, in order to minimize the increase in the risk of immunogenicity. One possible means includes the use of IgG subclass sequences. Human IgG subclasses include IgG1, IgG2, IgG3, and IgG4. By substituting portions of an antibody sequence with sequences of different subclasses according to a method disclosed in WO 2007/114325, the isoelectric point can be altered while suppressing the increase in the number of T-cell epitopes.

Alternative methods available include in silico T-cell epitope prediction tools such as Epibase.

Epibase Light (Lonza) is an in silico tool to calculate the binding capacity between 9-mer peptide and major DRB1 allele using FASTER algorism (Expert Opin Biol Ther. 2007 March; 7(3): 405-18). This tool enables identification of T-cell epitopes that strongly or moderately bind to MHC class II.

The calculation reflects the abundance ratio of DRB1 allotypes. For this purpose, it is possible to use the following abundance ratio in Caucasian populations.
DRB1*1501(24.5%), DRB1*0301(23.7%), DRB1*0701 (23.3%), DRB1*0101(15.0%), DRB1*1101(11.6%), DRB1*1302(8.2%), DRB1*1401/1454(4.9%), DRB1*0901 (2.3%), DRB1*1502(0.5%), DRB1*1202(0.1%)

All epitopes in each modified antibody sequence that exhibit strong or moderate binding are identified by FASTER algorism, and then critical epitopes are displayed after excluding human germline sequences and sequence of the junction of variable region and constant region. The number of T-cell epitopes increased by substitution of any amino acid residue for each residue in any sequence is calculated by using the randomization function of this tool. This enables selection of sties of residue substitution that results in an isoelectric point change without increasing the number of T-cell epitopes.

H240-AK072 (SEQ ID NO: 104) and H240-BH076 (SEQ ID NO: 105) were analyzed by Epibase. Table 67 shows as to H240-AK072 the number of T-cell epitopes that can be changed by substitution of any residue, while Table 68 shows the number for H240-BH076. Based on the results, one can select residue substitution that results in an isoelectric point change without increasing T-cell epitopes.

TABLE 67

| EU No. | AK072 sequence | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 118 | A | 0 | 0 | 0 | 0 | 1 | 0 | 0 | 0 | 0 | 0 | 0 | 0 | 0 | 0 | 0 | 0 | 0 | 0 | 0 | 0 |
| 119 | S | 0 | 0 | 0 | 0 | 1 | 0 | 0 | 1 | 0 | 1 | 1 | 0 | 0 | 0 | 0 | 0 | 0 | 1 | 1 | 1 |
| 120 | T | 0 | 0 | 0 | 0 | 1 | 0 | 0 | 1 | 0 | 1 | 1 | 0 | 0 | 0 | 0 | 0 | 0 | 1 | 1 | 1 |
| 121 | K | 0 | 0 | 0 | 0 | 1 | 0 | 0 | 0 | 0 | 0 | 0 | 0 | 0 | 0 | 0 | 0 | 0 | 0 | 1 | 0 |
| 122 | G | 0 | 0 | 0 | 0 | 1 | 0 | 0 | 0 | 0 | 0 | 0 | 0 | 0 | 0 | 0 | 0 | 0 | 0 | 0 | 1 |
| 123 | P | 1 | 0 | 0 | 0 | 2 | 0 | 1 | 1 | 1 | 2 | 1 | 0 | 0 | 0 | 2 | 1 | 0 | 1 | 2 | 2 |
| 124 | S | 0 | 0 | 0 | 0 | 2 | 0 | 0 | 2 | 2 | 2 | 2 | 1 | 0 | 1 | 2 | 0 | 0 | 1 | 1 | 1 |
| 125 | V | 0 | 0 | 0 | 0 | 1 | 0 | 0 | 1 | 0 | 1 | 1 | 0 | 0 | 0 | 0 | 0 | 0 | 0 | 1 | 1 |
| 126 | F | 0 | 1 | 0 | 1 | 0 | 0 | 1 | 2 | 2 | 2 | 2 | 2 | 0 | 1 | 2 | 1 | 1 | 2 | 3 | 2 |
| 127 | P | 4 | 3 | 3 | 3 | 4 | 3 | 3 | 4 | 2 | 4 | 4 | 3 | 0 | 3 | 2 | 3 | 3 | 4 | 4 | 4 |
| 128 | L | 1 | 1 | 2 | 2 | 3 | 1 | 2 | 3 | 4 | 0 | 3 | 2 | 1 | 2 | 3 | 2 | 1 | 3 | 3 | 3 |
| 129 | A | 0 | 3 | 3 | 3 | 4 | 3 | 3 | 3 | 3 | 3 | 3 | 3 | 2 | 4 | 3 | 3 | 3 | 3 | 4 | 3 |
| 130 | P | 3 | 3 | 3 | 3 | 4 | 3 | 3 | 4 | 3 | 4 | 4 | 3 | 0 | 3 | 4 | 3 | 3 | 3 | 5 | 4 |
| 131 | S | 3 | 3 | 3 | 3 | 4 | 3 | 2 | 4 | 3 | 4 | 4 | 3 | 3 | 3 | 3 | 0 | 3 | 4 | 3 | 4 |
| 132 | S | 3 | 3 | 3 | 3 | 4 | 3 | 3 | 4 | 3 | 4 | 4 | 3 | 3 | 3 | 3 | 0 | 3 | 4 | 4 | 4 |
| 133 | K | 3 | 2 | 3 | 3 | 3 | 2 | 3 | 3 | 0 | 3 | 3 | 3 | 3 | 3 | 3 | 3 | 3 | 3 | 3 | 3 |
| 134 | S | 3 | 3 | 3 | 3 | 4 | 3 | 3 | 4 | 3 | 4 | 5 | 3 | 3 | 3 | 3 | 0 | 3 | 4 | 4 | 4 |
| 135 | T | 2 | 2 | 2 | 1 | 3 | 2 | 2 | 4 | 2 | 4 | 4 | 2 | 2 | 2 | 3 | 2 | 0 | 2 | 3 | 3 |
| 136 | S | 1 | 1 | 1 | 1 | 2 | 1 | 1 | 2 | 1 | 2 | 3 | 1 | 1 | 1 | 1 | 0 | 1 | 1 | 2 | 2 |
| 137 | G | 1 | 1 | 1 | 1 | 2 | 0 | 1 | 2 | 1 | 3 | 2 | 1 | 1 | 1 | 1 | 1 | 1 | 2 | 2 | 2 |
| 138 | G | 0 | 1 | 0 | 0 | 1 | 0 | 0 | 1 | 1 | 2 | 1 | 0 | 0 | 0 | 1 | 0 | 0 | 1 | 1 | 1 |
| 139 | T | 1 | 1 | 0 | 0 | 3 | 0 | 1 | 3 | 1 | 3 | 3 | 0 | 0 | 1 | 1 | 0 | 0 | 3 | 1 | 3 |
| 140 | A | 0 | 0 | 0 | 0 | 1 | 0 | 1 | 1 | 1 | 1 | 1 | 0 | 0 | 0 | 1 | 0 | 0 | 1 | 1 | 1 |
| 141 | A | 0 | 0 | 0 | 0 | 2 | 0 | 0 | 2 | 0 | 1 | 1 | 0 | 0 | 0 | 0 | 0 | 0 | 0 | 2 | 2 |
| 142 | L | 0 | 0 | 0 | 0 | 0 | 0 | 0 | 0 | 0 | 0 | 0 | 0 | 0 | 0 | 1 | 0 | 0 | 0 | 0 | 1 |
| 143 | G | 2 | 0 | 1 | 1 | 2 | 0 | 1 | 2 | 1 | 2 | 2 | 1 | 1 | 2 | 1 | 1 | 1 | 2 | 2 | 2 |
| 144 | C | 2 | 0 | 0 | 1 | 4 | 2 | 3 | 5 | 2 | 5 | 5 | 2 | 2 | 3 | 3 | 2 | 1 | 4 | 4 | 4 |
| 145 | L | 0 | 0 | 1 | 1 | 0 | 0 | 1 | 0 | 1 | 0 | 0 | 0 | 0 | 1 | 1 | 1 | 0 | 0 | 1 | 0 |
| 146 | V | 0 | 0 | 0 | 0 | 2 | 0 | 1 | 0 | 1 | 2 | 1 | 1 | 0 | 1 | 1 | 1 | 0 | 1 | 1 | 1 |
| 147 | K | 0 | 0 | 0 | 0 | 3 | 0 | 1 | 3 | 0 | 3 | 3 | 1 | 1 | 2 | 1 | 1 | 3 | 1 | 3 |  |
| 148 | D | 2 | 2 | 0 | 2 | 4 | 2 | 3 | 4 | 4 | 4 | 4 | 2 | 2 | 3 | 3 | 3 | 3 | 4 | 4 | 4 |
| 149 | Y | 1 | 0 | 1 | 0 | 1 | 0 | 2 | 2 | 1 | 3 | 3 | 2 | 1 | 0 | 3 | 2 | 1 | 2 | 2 | 0 |
| 150 | F | 2 | 1 | 2 | 2 | 0 | 1 | 3 | 2 | 3 | 2 | 1 | 2 | 2 | 3 | 4 | 4 | 3 | 2 | 1 | 2 |
| 151 | P | 3 | 2 | 2 | 2 | 3 | 2 | 3 | 4 | 4 | 5 | 5 | 3 | 0 | 4 | 3 | 3 | 2 | 2 | 3 | 3 |
| 152 | E | 4 | 2 | 1 | 0 | 4 | 2 | 4 | 3 | 3 | 3 | 3 | 3 | 2 | 3 | 4 | 5 | 2 | 3 | 4 | 4 |
| 153 | P | 3 | 2 | 3 | 3 | 3 | 1 | 3 | 5 | 2 | 5 | 5 | 1 | 0 | 2 | 4 | 3 | 2 | 3 | 3 | 4 |
| 154 | V | 2 | 1 | 1 | 1 | 2 | 1 | 2 | 2 | 2 | 2 | 2 | 1 | 1 | 2 | 2 | 2 | 1 | 0 | 1 | 2 |
| 155 | T | 3 | 2 | 2 | 2 | 4 | 2 | 3 | 4 | 3 | 4 | 4 | 2 | 2 | 2 | 3 | 3 | 0 | 4 | 4 | 4 |
| 156 | V | 2 | 2 | 1 | 2 | 3 | 2 | 2 | 3 | 2 | 3 | 3 | 2 | 2 | 2 | 3 | 2 | 2 | 0 | 3 | 3 |
| 157 | S | 3 | 3 | 2 | 2 | 5 | 3 | 3 | 4 | 2 | 5 | 5 | 2 | 0 | 2 | 3 | 0 | 3 | 5 | 4 | 5 |
| 158 | W | 3 | 3 | 3 | 2 | 3 | 3 | 3 | 3 | 4 | 3 | 3 | 3 | 2 | 3 | 4 | 4 | 4 | 4 | 0 | 3 |
| 159 | N | 2 | 2 | 1 | 1 | 2 | 2 | 2 | 2 | 3 | 2 | 2 | 0 | 1 | 3 | 2 | 2 | 2 | 3 | 2 | 2 |
| 160 | S | 4 | 3 | 2 | 2 | 4 | 4 | 4 | 4 | 4 | 4 | 3 | 3 | 3 | 3 | 0 | 4 | 4 | 4 | 4 |  |
| 161 | G | 4 | 3 | 2 | 2 | 5 | 0 | 5 | 5 | 4 | 5 | 5 | 4 | 3 | 4 | 4 | 3 | 3 | 5 | 4 | 5 |
| 162 | A | 0 | 4 | 1 | 1 | 5 | 3 | 2 | 6 | 5 | 5 | 6 | 4 | 4 | 3 | 5 | 4 | 4 | 6 | 5 | 5 |
| 163 | L | 3 | 1 | 1 | 1 | 2 | 3 | 2 | 3 | 3 | 0 | 4 | 2 | 3 | 2 | 3 | 3 | 3 | 3 | 1 | 2 |
| 164 | T | 3 | 3 | 1 | 2 | 4 | 3 | 3 | 5 | 3 | 5 | 5 | 3 | 3 | 3 | 3 | 3 | 0 | 4 | 5 | 4 |
| 165 | S | 3 | 2 | 1 | 1 | 2 | 1 | 3 | 4 | 3 | 3 | 3 | 2 | 3 | 2 | 3 | 0 | 2 | 3 | 2 | 3 |
| 166 | G | 4 | 2 | 1 | 2 | 4 | 0 | 5 | 5 | 3 | 5 | 4 | 4 | 2 | 4 | 6 | 5 | 3 | 5 | 4 | 4 |
| 167 | V | 3 | 3 | 4 | 0 | 4 | 3 | 3 | 3 | 4 | 5 | 5 | 4 | 3 | 4 | 4 | 4 | 3 | 0 | 4 | 4 |
| 168 | H | 2 | 1 | 1 | 1 | 3 | 2 | 0 | 3 | 3 | 3 | 3 | 2 | 1 | 1 | 3 | 1 | 2 | 2 | 2 | 3 |
| 169 | T | 3 | 3 | 2 | 1 | 4 | 3 | 4 | 5 | 3 | 4 | 4 | 2 | 4 | 5 | 3 | 0 | 4 | 4 | 4 |  |
| 170 | F | 3 | 1 | 1 | 1 | 0 | 1 | 1 | 3 | 3 | 2 | 3 | 3 | 2 | 3 | 2 | 2 | 2 | 3 | 1 | 3 |
| 171 | P | 6 | 4 | 3 | 3 | 6 | 3 | 6 | 6 | 7 | 6 | 6 | 5 | 0 | 6 | 6 | 4 | 4 | 6 | 5 | 5 |
| 172 | A | 0 | 5 | 0 | 0 | 6 | 3 | 6 | 6 | 5 | 6 | 6 | 4 | 4 | 5 | 7 | 6 | 3 | 6 | 6 | 6 |
| 173 | V | 3 | 2 | 2 | 2 | 7 | 2 | 5 | 6 | 2 | 6 | 6 | 3 | 2 | 5 | 3 | 4 | 3 | 0 | 6 | 5 |
| 174 | L | 4 | 5 | 3 | 4 | 6 | 4 | 4 | 6 | 5 | 0 | 6 | 3 | 2 | 2 | 5 | 4 | 4 | 6 | 6 | 6 |
| 175 | Q | 5 | 4 | 5 | 4 | 5 | 5 | 7 | 6 | 7 | 6 | 6 | 5 | 4 | 0 | 7 | 6 | 6 | 5 | 6 | 6 |
| 176 | S | 7 | 6 | 3 | 4 | 6 | 6 | 6 | 6 | 6 | 6 | 6 | 5 | 5 | 5 | 6 | 0 | 6 | 6 | 6 | 0 |
| 177 | S | 6 | 3 | 3 | 4 | 5 | 4 | 5 | 6 | 5 | 5 | 5 | 3 | 3 | 5 | 0 | 5 | 6 | 6 | 5 |  |
| 178 | G | 8 | 7 | 5 | 4 | 8 | 0 | 8 | 8 | 8 | 8 | 8 | 6 | 7 | 7 | 9 | 7 | 7 | 8 | 8 | 8 |
| 179 | L | 4 | 6 | 4 | 2 | 7 | 5 | 6 | 7 | 6 | 0 | 7 | 6 | 5 | 7 | 6 | 6 | 5 | 7 | 7 | 7 |
| 180 | Y | 5 | 4 | 3 | 3 | 6 | 2 | 6 | 6 | 6 | 6 | 6 | 3 | 4 | 4 | 6 | 5 | 4 | 6 | 7 | 0 |
| 181 | S | 6 | 6 | 5 | 3 | 7 | 5 | 6 | 7 | 8 | 7 | 7 | 5 | 7 | 8 | 0 | 7 | 7 | 8 | 8 |  |
| 182 | L | 6 | 6 | 3 | 4 | 7 | 5 | 6 | 7 | 5 | 0 | 7 | 6 | 5 | 6 | 8 | 7 | 5 | 7 | 6 | 7 |
| 183 | S | 6 | 5 | 4 | 3 | 6 | 6 | 5 | 6 | 7 | 6 | 6 | 5 | 6 | 7 | 7 | 0 | 6 | 6 | 6 | 6 |
| 184 | S | 6 | 5 | 4 | 4 | 7 | 5 | 7 | 8 | 7 | 7 | 7 | 5 | 4 | 6 | 7 | 0 | 6 | 6 | 6 | 6 |
| 185 | V | 4 | 5 | 4 | 3 | 6 | 4 | 5 | 6 | 5 | 6 | 6 | 3 | 5 | 5 | 5 | 5 | 0 | 5 | 6 |  |
| 186 | V | 4 | 4 | 4 | 5 | 5 | 4 | 5 | 5 | 5 | 5 | 5 | 4 | 4 | 5 | 5 | 4 | 0 | 5 | 6 |  |
| 187 | T | 6 | 5 | 6 | 5 | 8 | 5 | 6 | 8 | 6 | 8 | 8 | 5 | 5 | 7 | 6 | 5 | 0 | 8 | 7 | 8 |
| 188 | V | 4 | 3 | 4 | 4 | 4 | 4 | 4 | 4 | 4 | 4 | 4 | 3 | 3 | 3 | 5 | 4 | 4 | 0 | 4 | 4 |
| 189 | P | 8 | 4 | 4 | 4 | 5 | 4 | 5 | 7 | 6 | 7 | 7 | 4 | 0 | 5 | 6 | 4 | 3 | 5 | 6 | 7 |
| 190 | S | 2 | 3 | 2 | 2 | 3 | 2 | 2 | 3 | 2 | 3 | 3 | 2 | 2 | 3 | 2 | 0 | 2 | 3 | 2 | 3 |
| 191 | S | 2 | 2 | 2 | 2 | 3 | 2 | 2 | 3 | 3 | 4 | 3 | 2 | 2 | 2 | 4 | 0 | 2 | 3 | 3 | 2 |
| 192 | S | 2 | 1 | 1 | 1 | 3 | 1 | 3 | 3 | 2 | 3 | 3 | 2 | 1 | 2 | 3 | 0 | 1 | 3 | 2 | 3 |
| 193 | L | 1 | 1 | 2 | 1 | 2 | 1 | 2 | 2 | 2 | 0 | 1 | 3 | 1 | 2 | 2 | 1 | 2 | 1 | 2 | 2 |
| 194 | G | 3 | 2 | 1 | 2 | 6 | 0 | 3 | 6 | 4 | 6 | 6 | 3 | 2 | 3 | 4 | 2 | 1 | 5 | 5 | 6 |

TABLE 67-continued

| EU No. | AK072 sequence | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 195 | T | 1 | 0 | 0 | 0 | 4 | 0 | 3 | 4 | 2 | 4 | 5 | 1 | 0 | 3 | 2 | 0 | 0 | 3 | 2 | 4 |
| 196 | Q | 2 | 1 | 1 | 0 | 3 | 2 | 1 | 3 | 2 | 4 | 3 | 2 | 1 | 0 | 4 | 2 | 1 | 3 | 3 | 3 |
| 197 | T | 1 | 1 | 1 | 1 | 2 | 1 | 1 | 5 | 1 | 3 | 3 | 2 | 0 | 1 | 2 | 1 | 0 | 3 | 4 | 3 |
| 198 | Y | 2 | 1 | 0 | 0 | 2 | 2 | 1 | 3 | 2 | 3 | 4 | 2 | 2 | 3 | 2 | 1 | 2 | 3 | 2 | 0 |
| 199 | I | 2 | 1 | 1 | 2 | 3 | 2 | 2 | 0 | 2 | 3 | 3 | 2 | 1 | 2 | 2 | 3 | 0 | 3 | 3 | 3 |
| 200 | C | 5 | 0 | 2 | 3 | 6 | 4 | 6 | 7 | 6 | 6 | 6 | 5 | 6 | 6 | 6 | 5 | 5 | 7 | 4 | 6 |
| 201 | N | 5 | 3 | 3 | 3 | 5 | 4 | 5 | 4 | 4 | 5 | 5 | 0 | 1 | 4 | 5 | 4 | 4 | 3 | 4 | 5 |
| 202 | V | 4 | 3 | 2 | 2 | 5 | 3 | 6 | 5 | 5 | 6 | 5 | 5 | 2 | 6 | 5 | 4 | 3 | 0 | 4 | 5 |
| 203 | N | 4 | 3 | 3 | 2 | 5 | 2 | 5 | 6 | 5 | 5 | 5 | 0 | 3 | 3 | 6 | 5 | 5 | 5 | 4 | 5 |
| 204 | H | 5 | 3 | 4 | 4 | 5 | 5 | 0 | 6 | 5 | 6 | 6 | 5 | 3 | 6 | 4 | 5 | 3 | 6 | 4 | 5 |
| 205 | K | 4 | 4 | 2 | 4 | 5 | 4 | 4 | 6 | 0 | 6 | 5 | 5 | 2 | 4 | 5 | 4 | 4 | 5 | 5 | 5 |
| 206 | P | 5 | 3 | 2 | 2 | 6 | 5 | 3 | 5 | 5 | 6 | 5 | 6 | 0 | 5 | 6 | 5 | 5 | 5 | 4 | 5 |
| 207 | S | 4 | 3 | 3 | 2 | 4 | 2 | 4 | 5 | 3 | 4 | 4 | 3 | 4 | 4 | 5 | 0 | 4 | 4 | 3 | 4 |
| 208 | N | 3 | 2 | 2 | 2 | 4 | 3 | 2 | 4 | 2 | 5 | 4 | 0 | 3 | 3 | 3 | 2 | 2 | 4 | 5 | 4 |
| 209 | T | 2 | 2 | 1 | 1 | 3 | 2 | 2 | 3 | 3 | 3 | 3 | 2 | 2 | 3 | 2 | 0 | 3 | 2 | 3 |
| 210 | K | 2 | 1 | 1 | 1 | 1 | 1 | 1 | 1 | 0 | 2 | 1 | 1 | 1 | 1 | 1 | 1 | 1 | 1 | 2 | 1 |
| 211 | V | 2 | 1 | 1 | 1 | 1 | 1 | 2 | 2 | 2 | 2 | 1 | 2 | 2 | 2 | 2 | 1 | 1 | 0 | 1 | 1 |
| 212 | D | 2 | 1 | 0 | 0 | 4 | 1 | 2 | 3 | 1 | 3 | 3 | 1 | 1 | 2 | 3 | 1 | 1 | 3 | 2 | 3 |
| 213 | K | 0 | 0 | 0 | 0 | 2 | 0 | 2 | 2 | 0 | 1 | 1 | 1 | 0 | 1 | 1 | 0 | 1 | 1 | 2 | 2 |
| 214 | K | 0 | 0 | 0 | 0 | 0 | 0 | 0 | 1 | 0 | 0 | 0 | 0 | 0 | 1 | 0 | 0 | 0 | 1 | 0 | 0 |
| 215 | V | 0 | 0 | 0 | 0 | 0 | 0 | 0 | 0 | 1 | 0 | 0 | 0 | 0 | 0 | 0 | 0 | 0 | 0 | 0 | 0 |
| 216 | E | 1 | 1 | 0 | 0 | 2 | 1 | 1 | 3 | 2 | 3 | 2 | 1 | 1 | 2 | 2 | 1 | 2 | 3 | 1 | 2 |
| 217 | P | 0 | 0 | 0 | 0 | 2 | 0 | 1 | 2 | 1 | 2 | 2 | 0 | 0 | 1 | 1 | 0 | 0 | 2 | 2 | 2 |
| 218 | K | 0 | 0 | 0 | 0 | 2 | 0 | 0 | 2 | 0 | 2 | 2 | 0 | 0 | 1 | 0 | 1 | 0 | 2 | 2 | 2 |
| 219 | S | 1 | 0 | 0 | 0 | 0 | 0 | 0 | 1 | 0 | 1 | 0 | 0 | 0 | 1 | 0 | 0 | 0 | 0 | 0 | 0 |
| 220 | C | 0 | 0 | 0 | 0 | 0 | 0 | 1 | 1 | 2 | 1 | 1 | 1 | 1 | 1 | 3 | 2 | 1 | 0 | 1 | 1 |
| 221 | D | 2 | 0 | 0 | 0 | 3 | 2 | 1 | 1 | 1 | 2 | 3 | 2 | 0 | 1 | 2 | 1 | 0 | 1 | 3 | 3 |
| 222 | K | 0 | 0 | 0 | 0 | 0 | 0 | 1 | 1 | 0 | 0 | 0 | 1 | 0 | 1 | 0 | 0 | 0 | 0 | 0 | 0 |
| 223 | T | 0 | 0 | 0 | 0 | 2 | 0 | 0 | 0 | 0 | 0 | 0 | 0 | 0 | 1 | 1 | 1 | 0 | 0 | 1 | 1 |
| 224 | H | 0 | 0 | 0 | 0 | 0 | 0 | 0 | 0 | 0 | 0 | 0 | 0 | 0 | 0 | 0 | 0 | 0 | 0 | 0 | 0 |
| 225 | T | 0 | 0 | 0 | 0 | 0 | 0 | 0 | 0 | 1 | 0 | 0 | 0 | 0 | 0 | 1 | 0 | 0 | 0 | 1 | 1 |
| 226 | C | 0 | 0 | 0 | 0 | 1 | 0 | 0 | 0 | 0 | 0 | 0 | 1 | 0 | 0 | 0 | 0 | 0 | 0 | 0 | 0 |
| 227 | P | 0 | 0 | 0 | 0 | 0 | 0 | 0 | 0 | 0 | 0 | 0 | 0 | 0 | 0 | 0 | 0 | 0 | 0 | 0 | 0 |
| 228 | P | 0 | 0 | 0 | 0 | 0 | 0 | 0 | 0 | 0 | 0 | 0 | 0 | 0 | 0 | 0 | 0 | 0 | 0 | 1 | 0 |
| 229 | C | 0 | 0 | 0 | 0 | 0 | 0 | 0 | 0 | 0 | 0 | 0 | 0 | 0 | 0 | 0 | 0 | 0 | 0 | 0 | 0 |
| 230 | P | 0 | 0 | 0 | 0 | 0 | 0 | 0 | 1 | 0 | 1 | 1 | 0 | 0 | 0 | 0 | 0 | 0 | 1 | 0 | 0 |
| 231 | A | 0 | 0 | 0 | 0 | 0 | 0 | 0 | 0 | 0 | 0 | 0 | 0 | 0 | 0 | 0 | 0 | 0 | 0 | 0 | 0 |
| 232 | P | 0 | 0 | −1 | −1 | 0 | 0 | −1 | 0 | 0 | 0 | 0 | 0 | 0 | 0 | 0 | 0 | 0 | 0 | 0 | 0 |
| 233 | E | 1 | 1 | 0 | 0 | 1 | 1 | 1 | 1 | 1 | 1 | 1 | 1 | 1 | 1 | 1 | 1 | 1 | 1 | 1 | 1 |
| 234 | Y | −1 | −1 | −2 | −2 | 0 | −1 | −1 | 1 | −1 | 0 | 0 | −1 | −1 | 0 | −1 | −1 | 0 | 0 | 0 | 0 |
| 235 | Y | −1 | −1 | −1 | −1 | 0 | −1 | −1 | −1 | 1 | 0 | −1 | −1 | −1 | −1 | −1 | −1 | −1 | 1 | 0 | 0 |
| 236 | W | −1 | −1 | −1 | −1 | −1 | −1 | −1 | −1 | 0 | −1 | −1 | −1 | −1 | 0 | −1 | −1 | −1 | 0 | 0 | 0 |
| 237 | G | 0 | 0 | −1 | −1 | 1 | 0 | 0 | 2 | 0 | 1 | 1 | 0 | −1 | 0 | 3 | 0 | −1 | 0 | 2 | 2 |
| 238 | P | 1 | 0 | 0 | 0 | 2 | 0 | 1 | 3 | 2 | 2 | 3 | 2 | 0 | 2 | 1 | 1 | 1 | 3 | 3 |
| 239 | S | −1 | 0 | −1 | −1 | 1 | 0 | −1 | 1 | 1 | 1 | 1 | −1 | 0 | 1 | 2 | 0 | 1 | 1 | 2 | 1 |
| 240 | V | −1 | −1 | −1 | −1 | 1 | −1 | 0 | 1 | 1 | 2 | 1 | 0 | −1 | −1 | 1 | 0 | 0 | 0 | 0 | 2 |
| 241 | F | 1 | −1 | −1 | −1 | 0 | −1 | 2 | 3 | 2 | 4 | 3 | 0 | 0 | −1 | 2 | 0 | 0 | 4 | 2 | 4 |
| 242 | L | 1 | 1 | 1 | 0 | 1 | 1 | 1 | 2 | 1 | 0 | 2 | 1 | 1 | 2 | 2 | 1 | 1 | 1 | 1 | 1 |
| 243 | F | 3 | 2 | 1 | 1 | 0 | 1 | 3 | 3 | 3 | 3 | 3 | 2 | 2 | 3 | 3 | 4 | 3 | 3 | 1 | 3 |
| 244 | P | 4 | 2 | 3 | 4 | 5 | 4 | 4 | 5 | 4 | 5 | 5 | 4 | 0 | 4 | 5 | 4 | 3 | 5 | 5 | 5 |
| 245 | P | 5 | 2 | 1 | 1 | 5 | 3 | 5 | 5 | 3 | 6 | 5 | 3 | 0 | 3 | 3 | 4 | 2 | 5 | 5 | 5 |
| 246 | K | 2 | 0 | 2 | 1 | 2 | 1 | 2 | 3 | 0 | 4 | 3 | 1 | 2 | 1 | 3 | 2 | 2 | 3 | 3 | 3 |
| 247 | P | 2 | 2 | 1 | 1 | 3 | 2 | 2 | 3 | 2 | 4 | 4 | 2 | 0 | 2 | 4 | 2 | 2 | 2 | 2 | 3 |
| 248 | K | 3 | 1 | 2 | 1 | 4 | 2 | 4 | 4 | 0 | 4 | 4 | 1 | 1 | 3 | 4 | 3 | 2 | 4 | 4 | 4 |
| 249 | D | 4 | 4 | 0 | 3 | 5 | 4 | 4 | 5 | 6 | 5 | 5 | 4 | 3 | 4 | 6 | 4 | 4 | 5 | 6 | 6 |
| 250 | T | 2 | 2 | 2 | 2 | 2 | 2 | 2 | 2 | 3 | 3 | 3 | 2 | 2 | 2 | 3 | 2 | 0 | 2 | 3 | 2 |
| 251 | L | 2 | 2 | 1 | 1 | 3 | 1 | 2 | 2 | 2 | 0 | 3 | 3 | 1 | 1 | 3 | 3 | 3 | 2 | 2 | 3 |
| 252 | M | 3 | 3 | 1 | 2 | 3 | 3 | 3 | 3 | 3 | 3 | 0 | 3 | 3 | 3 | 4 | 3 | 3 | 3 | 3 | 4 |
| 253 | I | 4 | 3 | 3 | 2 | 3 | 2 | 3 | 0 | 4 | 3 | 3 | 4 | 3 | 3 | 4 | 4 | 4 | 3 | 3 | 3 |
| 254 | S | 4 | 3 | 3 | 3 | 4 | 3 | 3 | 4 | 3 | 4 | 4 | 3 | 4 | 3 | 0 | 4 | 4 | 4 | 4 | 4 |
| 255 | R | 3 | 2 | 2 | 2 | 4 | 2 | 4 | 5 | 3 | 4 | 4 | 3 | 3 | 3 | 0 | 4 | 3 | 4 | 3 | 3 |
| 256 | T | 3 | 3 | 3 | 3 | 5 | 3 | 3 | 5 | 3 | 5 | 5 | 3 | 3 | 4 | 3 | 4 | 0 | 5 | 5 | 5 |
| 257 | P | 4 | 3 | 3 | 2 | 5 | 4 | 4 | 5 | 3 | 5 | 5 | 4 | 0 | 5 | 3 | 4 | 4 | 5 | 5 | 5 |
| 258 | E | 4 | 3 | 3 | 0 | 4 | 3 | 3 | 4 | 5 | 4 | 5 | 4 | 4 | 3 | 4 | 4 | 4 | 5 | 4 | 4 |
| 259 | V | 2 | 2 | 2 | 2 | 3 | 2 | 2 | 3 | 2 | 3 | 3 | 2 | 2 | 2 | 2 | 2 | 2 | 0 | 3 | 3 |
| 260 | T | 2 | 1 | 2 | 2 | 3 | 2 | 2 | 3 | 3 | 2 | 3 | 2 | 1 | 2 | 3 | 2 | 0 | 2 | 3 | 2 |
| 261 | C | 2 | 0 | 0 | 0 | 3 | 0 | 1 | 4 | 1 | 3 | 3 | 1 | 0 | 0 | 1 | 1 | 1 | 2 | 2 | 3 |
| 262 | V | −1 | −1 | −1 | −1 | 1 | −1 | 0 | 0 | 0 | 0 | 0 | −1 | 0 | 0 | 0 | −1 | 0 | 0 | 0 | 1 |
| 263 | V | 0 | −1 | −1 | −1 | −1 | −1 | −1 | 0 | −1 | 1 | 0 | −1 | −1 | −1 | −1 | −1 | 0 | 0 | 0 |
| 264 | V | 0 | −1 | −1 | −1 | −1 | −1 | −1 | 0 | 0 | −1 | 0 | 0 | 0 | 0 | 1 | 0 | 0 | 0 | −1 | 0 |
| 265 | D | 0 | 1 | 0 | 0 | 2 | 0 | 1 | 1 | −1 | 1 | 1 | 1 | 0 | 1 | −1 | 1 | 1 | 1 | 1 | 2 |
| 266 | V | −1 | 0 | −1 | −1 | 0 | −1 | 0 | −1 | 1 | 0 | 0 | 0 | 0 | 0 | 0 | −1 | 0 | −1 | 0 |
| 267 | S | −1 | −1 | 0 | 0 | −1 | 0 | 0 | 0 | −1 | −1 | 0 | 0 | 0 | 0 | 1 | −1 | −1 | −1 |
| 268 | D | 0 | −1 | 0 | −1 | 1 | 1 | −1 | 2 | 0 | 2 | 2 | 0 | 2 | 0 | 1 | 1 | 0 | 2 | 1 | 1 |
| 269 | E | 1 | 1 | 1 | 0 | 2 | 1 | 1 | 2 | 1 | 2 | 2 | 2 | 1 | 1 | 2 | 1 | 2 | 2 | 2 | 2 |
| 270 | E | 0 | 0 | 0 | 0 | 1 | 0 | 1 | 2 | 1 | 2 | 2 | 0 | 0 | 0 | 1 | 0 | 0 | 2 | 1 | 1 |
| 271 | P | 1 | 0 | 0 | 1 | 2 | 0 | 1 | 2 | 1 | 2 | 2 | 1 | 0 | 1 | 1 | 1 | 1 | 2 | 2 | 1 |

TABLE 67-continued

| EU No. | AK072 sequence | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 272 | E | 0 | 0 | 0 | 0 | 1 | 0 | 0 | 1 | 0 | 1 | 1 | 0 | 0 | 0 | 1 | 0 | 0 | 1 | 1 | 1 |
| 273 | V | 0 | 0 | 0 | 0 | 0 | 0 | 0 | 0 | 0 | 0 | 0 | 0 | 0 | 0 | 0 | 0 | 0 | 0 | 1 | 0 |
| 274 | K | 0 | 0 | 0 | 0 | 1 | 0 | 0 | 1 | 0 | 1 | 1 | 0 | 0 | 0 | 0 | 0 | 0 | 0 | 1 | 1 |
| 275 | F | 0 | 0 | 0 | 0 | 0 | 0 | 0 | 1 | 1 | 1 | 1 | 0 | 0 | 0 | 0 | 0 | 0 | 1 | 1 | 1 |
| 276 | N | 1 | 1 | 1 | 1 | 3 | 1 | 2 | 3 | 1 | 3 | 3 | 0 | 1 | 2 | 2 | 2 | 2 | 3 | 3 | 3 |
| 277 | W | 1 | 1 | 0 | 0 | 2 | 1 | 1 | 2 | 2 | 2 | 2 | 1 | 0 | 1 | 2 | 2 | 2 | 2 | 0 | 2 |
| 278 | Y | 2 | 1 | 1 | 0 | 2 | 1 | 2 | 2 | 3 | 3 | 2 | 2 | 2 | 3 | 3 | 3 | 3 | 3 | 2 | 0 |
| 279 | V | 2 | 2 | 1 | 1 | 2 | 2 | 2 | 2 | 2 | 2 | 2 | 2 | 2 | 3 | 2 | 2 | 2 | 0 | 2 | 2 |
| 280 | D | 4 | 3 | 0 | 2 | 6 | 3 | 4 | 5 | 6 | 5 | 5 | 3 | 2 | 5 | 6 | 4 | 4 | 5 | 5 | 7 |
| 281 | G | 3 | 3 | 2 | 2 | 3 | 0 | 3 | 4 | 3 | 5 | 5 | 3 | 2 | 3 | 4 | 3 | 2 | 3 | 3 | 3 |
| 282 | V | 3 | 2 | 1 | 2 | 2 | 2 | 3 | 2 | 3 | 2 | 0 | 2 | 3 | 2 | 4 | 3 | 2 | 0 | 2 | 2 |
| 283 | E | 4 | 3 | 2 | 0 | 6 | 4 | 3 | 6 | 5 | 7 | 6 | 4 | 4 | 4 | 7 | 4 | 4 | 7 | 5 | 6 |
| 284 | V | 3 | 2 | 1 | 1 | 3 | 2 | 2 | 3 | 3 | 4 | 3 | 4 | 2 | 2 | 2 | 2 | 2 | 0 | 3 | 3 |
| 285 | H | 4 | 3 | 2 | 2 | 4 | 3 | 0 | 4 | 3 | 4 | 4 | 3 | 2 | 4 | 3 | 3 | 2 | 4 | 3 | 4 |
| 286 | N | 3 | 3 | 2 | 2 | 4 | 3 | 3 | 4 | 3 | 5 | 4 | 0 | 3 | 3 | 4 | 3 | 3 | 3 | 4 | 4 |
| 287 | A | 0 | 2 | 2 | 1 | 2 | 2 | 2 | 2 | 3 | 2 | 2 | 2 | 1 | 2 | 3 | 2 | 1 | 2 | 3 | 3 |
| 288 | K | 1 | 0 | 0 | 0 | 2 | 1 | 3 | 3 | 0 | 3 | 3 | 3 | 2 | 1 | 2 | 2 | 2 | 3 | 2 | 2 |
| 289 | T | 2 | 1 | 2 | 2 | 3 | 2 | 4 | 3 | 4 | 3 | 3 | 3 | 1 | 3 | 4 | 2 | 0 | 3 | 2 | 3 |
| 290 | K | 1 | 1 | 1 | 0 | 3 | 1 | 2 | 4 | 0 | 4 | 3 | 2 | 2 | 2 | 2 | 1 | 3 | 3 | 3 | 4 |
| 291 | P | 1 | 2 | 1 | 2 | 5 | 1 | 3 | 2 | 2 | 0 | 3 | 1 | 0 | 2 | 3 | 2 | 2 | 3 | 1 | 3 |
| 292 | R | 0 | 1 | 0 | 0 | 2 | 0 | 1 | 2 | 1 | 2 | 2 | 0 | 0 | 0 | 0 | 1 | 0 | 2 | 0 | 2 |
| 293 | E | 1 | 0 | 1 | 0 | 3 | 1 | 2 | 3 | 2 | 3 | 2 | 1 | 1 | 2 | 2 | 2 | 3 | 2 | 3 | 3 |
| 294 | E | 2 | 2 | 1 | 0 | 3 | 1 | 3 | 4 | 3 | 4 | 3 | 1 | 3 | 2 | 3 | 2 | 4 | 2 | 3 |
| 295 | Q | -1 | -1 | -1 | -1 | 1 | -1 | -1 | 1 | -1 | 1 | 1 | 0 | -1 | 0 | -1 | -1 | -1 | 1 | 0 | 1 |
| 296 | Y | -2 | -2 | -2 | -2 | 0 | -2 | 0 | 0 | 0 | -1 | -1 | -2 | -2 | -2 | 0 | -1 | -2 | -1 | 0 | 0 |
| 297 | N | 0 | 0 | -1 | -1 | 1 | -1 | 2 | 0 | 1 | 1 | 1 | 0 | -1 | 0 | 1 | 0 | 1 | 0 | 1 | 1 |
| 298 | A | 0 | -1 | -1 | -1 | 2 | -1 | -1 | 2 | 2 | 2 | 2 | 0 | -1 | 0 | 2 | -2 | -1 | 2 | 1 | 2 |
| 299 | T | 1 | 1 | 0 | 0 | 1 | 1 | 0 | 2 | 1 | 2 | 2 | 0 | 1 | 0 | 2 | 0 | 0 | 2 | 1 | 2 |
| 300 | Y | 2 | 2 | -1 | 0 | 0 | 1 | 2 | 1 | 1 | 2 | 2 | 2 | 0 | 1 | 4 | 3 | 3 | 1 | 1 | 0 |
| 301 | R | 2 | 2 | -1 | 0 | 3 | 2 | 2 | 3 | 1 | 4 | 4 | 1 | 1 | 2 | 0 | 1 | 1 | 3 | 3 | 4 |
| 302 | V | 4 | 3 | 2 | 2 | 3 | 3 | 3 | 3 | 3 | 3 | 3 | 4 | 2 | 3 | 4 | 4 | 3 | 0 | 3 | 3 |
| 303 | V | 3 | 3 | 3 | 2 | 4 | 3 | 3 | 5 | 5 | 5 | 5 | 4 | 3 | 3 | 3 | 4 | 4 | 0 | 5 | 5 |
| 304 | S | 4 | 4 | 3 | 3 | 5 | 4 | 5 | 6 | 5 | 5 | 5 | 4 | 4 | 7 | 6 | 0 | 4 | 7 | 5 | 5 |
| 305 | V | 4 | 4 | 3 | 4 | 5 | 4 | 4 | 5 | 4 | 5 | 6 | 4 | 4 | 4 | 4 | 4 | 0 | 5 | 5 |
| 306 | L | 8 | 6 | 3 | 3 | 7 | 6 | 6 | 7 | 7 | 0 | 7 | 6 | 6 | 6 | 7 | 6 | 6 | 7 | 6 | 7 |
| 307 | T | 7 | 6 | 5 | 5 | 8 | 6 | 7 | 7 | 6 | 8 | 8 | 6 | 7 | 6 | 6 | 6 | 0 | 7 | 9 | 7 |
| 308 | V | 6 | 6 | 5 | 5 | 7 | 5 | 7 | 7 | 5 | 8 | 8 | 6 | 5 | 6 | 5 | 6 | 6 | 0 | 6 | 7 |
| 309 | L | 5 | 4 | 4 | 4 | 6 | 5 | 4 | 7 | 5 | 0 | 6 | 6 | 6 | 5 | 6 | 7 | 6 | 0 | 5 | 6 |
| 310 | H | 5 | 3 | 3 | 2 | 6 | 4 | 0 | 6 | 5 | 6 | 5 | 4 | 5 | 7 | 6 | 6 | 5 | 5 | 5 | 6 |
| 311 | Q | 4 | 4 | 3 | 4 | 5 | 4 | 4 | 5 | 4 | 5 | 5 | 4 | 0 | 6 | 4 | 4 | 4 | 5 | 5 |
| 312 | D | 4 | 5 | 0 | 2 | 6 | 4 | 5 | 7 | 5 | 8 | 6 | 5 | 4 | 4 | 6 | 5 | 5 | 6 | 7 | 6 |
| 313 | W | 3 | 1 | 1 | 1 | 3 | 3 | 4 | 3 | 2 | 3 | 3 | 2 | 2 | 1 | 3 | 3 | 3 | 3 | 0 | 3 |
| 314 | L | 2 | 2 | 2 | 2 | 3 | 2 | 3 | 3 | 4 | 0 | 3 | 3 | 2 | 4 | 2 | 4 | 3 | 3 | 3 |
| 315 | N | 2 | 2 | 1 | 1 | 2 | 2 | 3 | 4 | 2 | 4 | 3 | 0 | 2 | 3 | 3 | 2 | 3 | 2 | 2 |
| 316 | G | 1 | 1 | 0 | 0 | 3 | 0 | 1 | 2 | 0 | 3 | 2 | 2 | 0 | 2 | 2 | 0 | 0 | 2 | 2 | 4 |
| 317 | K | 1 | 1 | 0 | 0 | 2 | 1 | 2 | 2 | 0 | 2 | 1 | 1 | 1 | 1 | 4 | 2 | 1 | 1 | 2 | 2 |
| 318 | E | 2 | 1 | 2 | 0 | 3 | 2 | 2 | 4 | 2 | 3 | 4 | 2 | 2 | 2 | 3 | 3 | 4 | 3 | 4 | 4 |
| 319 | Y | 2 | 1 | 1 | 1 | 2 | 1 | 1 | 2 | 3 | 2 | 2 | 1 | 1 | 1 | 3 | 1 | 1 | 2 | 2 | 0 |
| 320 | K | 3 | 2 | 1 | 1 | 4 | 3 | 2 | 4 | 0 | 4 | 4 | 3 | 2 | 3 | 3 | 2 | 2 | 4 | 3 | 4 |
| 321 | C | 3 | 0 | 2 | 3 | 4 | 3 | 4 | 3 | 4 | 3 | 3 | 2 | 2 | 3 | 5 | 4 | 3 | 3 | 3 | 4 |
| 322 | K | 3 | 1 | 1 | 1 | 5 | 2 | 4 | 5 | 0 | 5 | 5 | 2 | 3 | 2 | 4 | 2 | 4 | 5 | 4 | 5 |
| 323 | V | 3 | 2 | 2 | 2 | 3 | 2 | 2 | 3 | 3 | 3 | 3 | 5 | 3 | 4 | 3 | 3 | 2 | 0 | 3 | 3 |
| 324 | S | 4 | 4 | 3 | 1 | 5 | 4 | 4 | 6 | 6 | 6 | 6 | 5 | 3 | 5 | 6 | 0 | 5 | 4 | 4 | 5 |
| 325 | N | 5 | 4 | 3 | 3 | 6 | 4 | 4 | 6 | 6 | 6 | 6 | 0 | 4 | 4 | 6 | 6 | 6 | 7 | 5 | 5 |
| 326 | K | 3 | 3 | 2 | 3 | 3 | 4 | 4 | 0 | 4 | 4 | 3 | 3 | 5 | 3 | 3 | 4 | 3 | 4 |
| 327 | A | 0 | 2 | 2 | 1 | 5 | 0 | 3 | 4 | 3 | 5 | 4 | 3 | 3 | 3 | 4 | 4 | 5 | 5 | 3 | 4 |
| 328 | L | 2 | 2 | 2 | 2 | 3 | 2 | 3 | 3 | 4 | 0 | 3 | 4 | 3 | 4 | 5 | 3 | 3 | 3 | 3 | 3 |
| 329 | P | 2 | 2 | 1 | 1 | 3 | 2 | 3 | 6 | 3 | 4 | 4 | 3 | 0 | 3 | 4 | 2 | 2 | 4 | 2 | 4 |
| 330 | A | 0 | 2 | 3 | 3 | 3 | 2 | 2 | 4 | 3 | 3 | 3 | 2 | 2 | 2 | 3 | 3 | 2 | 3 | 3 | 3 |
| 331 | P | 4 | 1 | 2 | 3 | 4 | 2 | 3 | 4 | 2 | 4 | 4 | 2 | 0 | 2 | 3 | 3 | 3 | 4 | 3 | 4 |
| 332 | I | 2 | 0 | 0 | 0 | 1 | 1 | 1 | 0 | 0 | 2 | 2 | 0 | 1 | 0 | 1 | 1 | 0 | 1 | 2 | 1 |
| 333 | E | 3 | 3 | 2 | 0 | 4 | 3 | 3 | 4 | 4 | 5 | 4 | 3 | 2 | 4 | 4 | 3 | 3 | 4 | 3 | 4 |
| 334 | K | 0 | 0 | 0 | 0 | 4 | 0 | 1 | 2 | 0 | 1 | 1 | 0 | 0 | 0 | 1 | 0 | 0 | 1 | 2 | 2 |
| 335 | T | 2 | 1 | 0 | 0 | 2 | 2 | 1 | 3 | 2 | 3 | 3 | 3 | 1 | 3 | 2 | 1 | 0 | 2 | 1 | 2 |
| 336 | I | 0 | 0 | 0 | 0 | 2 | 0 | 0 | 0 | 2 | 1 | 1 | 0 | 0 | 1 | 1 | 0 | 0 | 0 | 2 | 1 |
| 337 | S | 2 | 1 | 0 | 0 | 3 | 1 | 2 | 2 | 1 | 3 | 2 | 3 | 0 | 2 | 1 | 0 | 1 | 3 | 2 | 2 |
| 338 | K | 2 | 0 | 0 | 0 | 1 | 0 | 2 | 2 | 0 | 2 | 2 | 0 | 1 | 0 | 3 | 0 | 0 | 2 | 1 | 2 |
| 339 | A | 0 | 1 | 1 | 0 | 2 | 0 | 2 | 2 | 2 | 3 | 2 | 2 | 1 | 1 | 2 | 2 | 0 | 2 | 2 | 2 |
| 340 | K | 1 | 0 | 1 | 2 | 3 | 1 | 3 | 3 | 0 | 3 | 3 | 2 | 2 | 2 | 2 | 2 | 2 | 3 | 3 | 3 |
| 341 | G | 2 | 2 | 1 | 1 | 4 | 0 | 3 | 6 | 3 | 3 | 3 | 3 | 3 | 5 | 3 | 3 | 3 | 4 | 1 | 4 |
| 342 | Q | 4 | 1 | 1 | 1 | 5 | 2 | 4 | 5 | 5 | 5 | 5 | 2 | 2 | 0 | 4 | 4 | 2 | 4 | 5 | 4 |
| 343 | P | 2 | 1 | 1 | 1 | 4 | 2 | 3 | 1 | 2 | 4 | 2 | 3 | 0 | 2 | 2 | 2 | 2 | 3 | 2 | 2 |
| 344 | R | 1 | 1 | 1 | 2 | 1 | 2 | 1 | 1 | 2 | 1 | 1 | 1 | 0 | 1 | 0 | 1 | 1 | 1 | 3 | 1 |
| 345 | E | 3 | 3 | 2 | 0 | 4 | 3 | 2 | 4 | 3 | 4 | 4 | 2 | 3 | 3 | 3 | 3 | 3 | 4 | 4 | 4 |
| 346 | P | 2 | 1 | 1 | 0 | 2 | 1 | 2 | 2 | 2 | 2 | 2 | 1 | 0 | 2 | 2 | 2 | 2 | 2 | 2 | 2 |
| 347 | Q | 3 | 1 | 1 | 1 | 3 | 1 | 2 | 3 | 2 | 3 | 3 | 2 | 1 | 0 | 2 | 2 | 2 | 2 | 1 | 3 |
| 348 | V | 2 | 2 | -1 | 0 | 2 | 1 | 1 | 2 | 3 | 2 | 2 | 1 | 1 | 3 | 2 | 2 | 0 | 2 | 2 |

TABLE 67-continued

| EU No. | AK072 sequence | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 349 | Y | 2 | 1 | 1 | 1 | 2 | 2 | 2 | 2 | 2 | 2 | 2 | 3 | 1 | 2 | 2 | 1 | 2 | 2 | 3 | 0 |
| 350 | T | 2 | 2 | 3 | 2 | 3 | 2 | 2 | 4 | 2 | 4 | 4 | 3 | 2 | 3 | 3 | 2 | 0 | 4 | 3 | 4 |
| 351 | L | 0 | −2 | 0 | −2 | 0 | −1 | −1 | 0 | −1 | 0 | 1 | 0 | −1 | 0 | −1 | 0 | −1 | 0 | 0 | 1 |
| 352 | P | 2 | 2 | 1 | 1 | 2 | 2 | 3 | 2 | 3 | 3 | 2 | 3 | 0 | 2 | 3 | 3 | 3 | 2 | 2 | 2 |
| 353 | P | 2 | 0 | 0 | −1 | 2 | 0 | 0 | 2 | 0 | 3 | 1 | 1 | 0 | 1 | 0 | 1 | 0 | 1 | 0 | 1 |
| 354 | S | 1 | 0 | 1 | 0 | 1 | 0 | 2 | 1 | 2 | 2 | 2 | 1 | 0 | 2 | 2 | 0 | 1 | 1 | 1 | 2 |
| 355 | R | 0 | −1 | −1 | 0 | 2 | 0 | 1 | 1 | 0 | 2 | 2 | 1 | 0 | −1 | 0 | 0 | 0 | 2 | 1 | 1 |
| 356 | K | −3 | −3 | −3 | −4 | −1 | −3 | −1 | −1 | 0 | −1 | −1 | −1 | −3 | −1 | 0 | −3 | −2 | −1 | −1 | −1 |
| 357 | E | 1 | 0 | −1 | 0 | 2 | 1 | 1 | 2 | 1 | 2 | 3 | 2 | −1 | 1 | 1 | 1 | 1 | 3 | 2 | 2 |
| 353 | M | −2 | −3 | −3 | −3 | −1 | −2 | 0 | 0 | −1 | 0 | 0 | −2 | −2 | −2 | 0 | −2 | −1 | −1 | 0 | 1 |
| 359 | T | 1 | −1 | 1 | 1 | 2 | 0 | 2 | 2 | 2 | 2 | 2 | 2 | −2 | 2 | 2 | 1 | 0 | 2 | 2 | 2 |
| 360 | K | 0 | −1 | −2 | −3 | 1 | −1 | 0 | 1 | 0 | 2 | 2 | −1 | −2 | 0 | 2 | 0 | −1 | 2 | 1 | 1 |
| 361 | N | 2 | 1 | −1 | 0 | 2 | 1 | 0 | 2 | 3 | 2 | 2 | 0 | 1 | 2 | 3 | 3 | 2 | 2 | 2 | 2 |
| 362 | Q | 1 | 0 | −2 | −2 | 4 | 0 | 0 | 4 | 1 | 3 | 3 | 2 | 0 | 0 | 2 | 1 | 1 | 3 | 2 | 4 |
| 363 | V | 0 | 0 | −1 | −1 | 2 | 0 | 2 | 2 | 2 | 1 | 2 | 1 | 1 | 2 | 3 | 2 | 2 | 0 | 3 | 1 |
| 364 | S | 1 | −1 | 0 | 0 | 4 | 0 | 1 | 4 | 0 | 4 | 3 | 2 | 0 | 0 | 2 | 0 | 1 | 4 | 2 | 4 |
| 365 | L | 3 | 1 | 0 | 0 | 2 | 1 | 3 | 4 | 2 | 0 | 4 | 3 | 2 | 3 | 2 | 3 | 1 | 3 | 2 | 2 |
| 366 | T | 5 | 2 | 2 | 2 | 5 | 2 | 3 | 6 | 1 | 6 | 6 | 4 | 1 | 3 | 3 | 4 | 0 | 5 | 3 | 5 |
| 367 | C | 5 | 0 | 3 | 2 | 4 | 4 | 5 | 4 | 5 | 4 | 4 | 4 | 3 | 4 | 6 | 4 | 4 | 4 | 4 | 4 |
| 368 | L | 3 | 2 | 2 | 2 | 4 | 2 | 4 | 5 | 3 | 0 | 2 | 4 | 2 | 3 | 4 | 4 | 3 | 2 | 2 | 3 |
| 369 | V | 2 | 1 | 1 | 1 | 5 | 1 | 1 | 3 | 2 | 3 | 3 | 2 | 1 | 2 | 3 | 1 | 1 | 0 | 2 | 2 |
| 370 | K | 4 | 3 | 4 | 4 | 5 | 3 | 3 | 5 | 0 | 5 | 5 | 3 | 3 | 4 | 5 | 5 | 4 | 6 | 5 | 5 |
| 371 | G | 5 | 5 | 2 | 4 | 5 | 0 | 4 | 6 | 5 | 5 | 5 | 4 | 3 | 4 | 6 | 5 | 5 | 6 | 6 | 5 |
| 372 | F | 2 | 2 | 2 | 1 | 0 | 1 | 4 | 5 | 4 | 5 | 5 | 2 | 2 | 3 | 5 | 2 | 4 | 5 | 3 | 5 |
| 373 | Y | 6 | 3 | 4 | 4 | 4 | 4 | 4 | 6 | 4 | 5 | 6 | 4 | 3 | 6 | 5 | 5 | 4 | 5 | 3 | 0 |
| 374 | P | 5 | 4 | 3 | 5 | 7 | 4 | 6 | 7 | 5 | 8 | 7 | 5 | 0 | 5 | 6 | 8 | 7 | 7 | 7 | 7 |
| 375 | S | 4 | 2 | 2 | 2 | 3 | 2 | 2 | 3 | 4 | 3 | 3 | 3 | 2 | 3 | 4 | 0 | 2 | 3 | 3 | 3 |
| 376 | D | 5 | 4 | 0 | 3 | 4 | 4 | 5 | 4 | 4 | 5 | 5 | 3 | 4 | 5 | 5 | 6 | 5 | 4 | 3 | 5 |
| 377 | I | 2 | 2 | 2 | 2 | 4 | 2 | 4 | 0 | 2 | 4 | 3 | 4 | 2 | 3 | 3 | 2 | 3 | 3 | 3 | 3 |
| 378 | A | 0 | 2 | 2 | 2 | 2 | 2 | 4 | 3 | 3 | 3 | 2 | 3 | 3 | 4 | 3 | 0 | 3 | 3 | 2 | 3 |
| 379 | V | 1 | 1 | 1 | 1 | 3 | 1 | 2 | 3 | 1 | 3 | 0 | 1 | 1 | 2 | 1 | 1 | 1 | 0 | 3 | 3 |
| 380 | E | 2 | 2 | 1 | 0 | 4 | 2 | 2 | 5 | 3 | 4 | 5 | 3 | 2 | 3 | 3 | 2 | 2 | 5 | 4 | 5 |
| 381 | W | 2 | 1 | 1 | 1 | 2 | 1 | 2 | 1 | 1 | 1 | 3 | 1 | 1 | 1 | 2 | 1 | 1 | 1 | 0 | 3 |
| 382 | E | 3 | 1 | 0 | 0 | 2 | 1 | 2 | 3 | 1 | 3 | 3 | 3 | 1 | 2 | 3 | 3 | 3 | 2 | 2 | 3 |
| 383 | S | 0 | 0 | 0 | 0 | 0 | 0 | 1 | 1 | 0 | 0 | 1 | 0 | 0 | 0 | 0 | 0 | 0 | 0 | 0 | 1 |
| 384 | N | 0 | 0 | 0 | 0 | 0 | 0 | 0 | 1 | 1 | 1 | 1 | 0 | 0 | 0 | 1 | 0 | 0 | 0 | 0 | 0 |
| 385 | G | 2 | 0 | 0 | 0 | 2 | 0 | 0 | 3 | 2 | 2 | 3 | 1 | 0 | 0 | 2 | 1 | 0 | 2 | 1 | 3 |
| 386 | Q | 1 | 1 | 0 | 1 | 1 | 1 | 1 | 1 | 1 | 1 | 1 | 0 | 1 | 0 | 1 | 1 | 1 | 1 | 1 | 1 |
| 387 | P | 1 | 0 | 1 | 1 | 2 | 0 | 2 | 2 | 0 | 2 | 3 | 1 | 0 | 1 | 1 | 1 | 2 | 2 | 0 | 2 |
| 388 | E | 1 | 1 | 0 | 0 | 3 | 1 | 2 | 3 | 1 | 3 | 4 | 2 | 1 | 2 | 1 | 1 | 1 | 3 | 3 | 3 |
| 389 | N | 1 | 1 | 1 | 1 | 2 | 1 | 1 | 2 | 2 | 2 | 2 | 0 | 0 | 1 | 2 | 1 | 2 | 2 | 2 | 2 |
| 390 | N | 1 | 1 | 0 | 0 | 2 | 2 | 1 | 2 | 2 | 2 | 2 | 0 | 0 | 2 | 2 | 2 | 2 | 2 | 2 | 2 |
| 391 | Y | 1 | 0 | 0 | 1 | 2 | 1 | 1 | 2 | 2 | 3 | 2 | 1 | 1 | 2 | 2 | 1 | 1 | 2 | 2 | 0 |
| 392 | K | 2 | 2 | 2 | 2 | 3 | 2 | 3 | 3 | 0 | 3 | 3 | 0 | 0 | 2 | 3 | 3 | 2 | 3 | 3 | 3 |
| 393 | T | 2 | 2 | 1 | 1 | 1 | 1 | 2 | 2 | 1 | 3 | 3 | 3 | 1 | 2 | 2 | 3 | 0 | 3 | 1 | 1 |
| 394 | T | 2 | 1 | 1 | 1 | 1 | 2 | 1 | 2 | 3 | 2 | 2 | 2 | 1 | 2 | 3 | 2 | 0 | 2 | 1 | 2 |
| 395 | P | 3 | 2 | 1 | 1 | 3 | 2 | 1 | 3 | 2 | 3 | 3 | 3 | 0 | 2 | 2 | 3 | 3 | 3 | 2 | 3 |
| 396 | P | 2 | 3 | 0 | 0 | 3 | 1 | 3 | 4 | 1 | 4 | 4 | 2 | 0 | 1 | 3 | 2 | 4 | 3 | 3 | 3 |
| 397 | V | 2 | 2 | 2 | 2 | 1 | 2 | 2 | 3 | 0 | 3 | 0 | 3 | 2 | 2 | 3 | 2 | 0 | 1 | 1 | 1 |
| 398 | L | 2 | 2 | 2 | 1 | 3 | 2 | 2 | 4 | 2 | 0 | 3 | 2 | 2 | 2 | 2 | 2 | 2 | 3 | 3 | 3 |
| 399 | D | 4 | 3 | 0 | 2 | 4 | 3 | 4 | 4 | 4 | 5 | 5 | 4 | 3 | 3 | 4 | 3 | 3 | 4 | 4 | 4 |
| 400 | S | 2 | 2 | 2 | 1 | 2 | 2 | 3 | 2 | 2 | 3 | 3 | 2 | 2 | 2 | 2 | 0 | 2 | 2 | 2 | 2 |
| 401 | D | 1 | 1 | 0 | 0 | 2 | 1 | 3 | 3 | 3 | 3 | 3 | 0 | 1 | 2 | 3 | 1 | 2 | 2 | 2 | 3 |
| 402 | G | 3 | 1 | 1 | 1 | 2 | 0 | 2 | 2 | 2 | 2 | 2 | 2 | 2 | 2 | 2 | 2 | 2 | 2 | 2 | 2 |
| 403 | S | 2 | 2 | 1 | 1 | 3 | 2 | 3 | 3 | 4 | 2 | 2 | 3 | 3 | 0 | 2 | 3 | 0 | 2 | 3 | 3 |
| 404 | F | 3 | 3 | 2 | 3 | 0 | 3 | 2 | 3 | 2 | 4 | 3 | 4 | 3 | 3 | 3 | 3 | 3 | 3 | 3 | 3 |
| 405 | F | 3 | 3 | 1 | 2 | 0 | 3 | 3 | 4 | 3 | 5 | 4 | 3 | 3 | 3 | 3 | 3 | 3 | 4 | 3 | 4 |
| 406 | L | 4 | 2 | 3 | 3 | 4 | 2 | 4 | 4 | 4 | 0 | 4 | 2 | 1 | 3 | 4 | 4 | 3 | 4 | 5 | 6 |
| 407 | Y | 5 | 4 | 2 | 3 | 7 | 4 | 4 | 5 | 6 | 5 | 5 | 6 | 4 | 6 | 6 | 5 | 6 | 6 | 6 | 0 |
| 408 | S | 6 | 4 | 3 | 3 | 6 | 5 | 4 | 5 | 5 | 6 | 6 | 3 | 5 | 5 | 0 | 4 | 5 | 6 | 5 |  |
| 409 | K | 5 | 5 | 4 | 5 | 6 | 4 | 5 | 7 | 0 | 7 | 7 | 5 | 4 | 5 | 0 | 5 | 4 | 7 | 6 | 6 |
| 410 | L | 4 | 3 | 4 | 4 | 6 | 3 | 4 | 5 | 6 | 0 | 4 | 3 | 3 | 4 | 6 | 3 | 3 | 4 | 7 | 5 |
| 411 | T | 5 | 5 | 5 | 4 | 8 | 4 | 6 | 9 | 4 | 8 | 8 | 6 | 6 | 6 | 8 | 6 | 0 | 8 | 7 | 8 |
| 412 | V | 5 | 4 | 2 | 4 | 6 | 4 | 5 | 5 | 4 | 6 | 6 | 4 | 4 | 4 | 5 | 4 | 4 | 0 | 4 | 5 |
| 413 | D | 7 | 7 | 0 | 3 | 8 | 6 | 7 | 8 | 8 | 7 | 8 | 7 | 6 | 8 | 9 | 6 | 7 | 7 | 7 | 8 |
| 414 | K | 3 | 3 | 3 | 3 | 5 | 3 | 4 | 4 | 0 | 5 | 5 | 3 | 2 | 3 | 3 | 3 | 4 | 4 | 4 | 5 |
| 415 | S | 3 | 2 | 1 | 1 | 4 | 1 | 2 | 4 | 3 | 3 | 3 | 2 | 2 | 2 | 4 | 0 | 2 | 2 | 3 | 3 |
| 416 | R | 2 | 1 | 1 | 1 | 3 | 1 | 1 | 3 | 1 | 3 | 3 | 2 | 2 | 2 | 0 | 1 | 1 | 3 | 2 | 3 |
| 417 | W | 2 | 2 | 2 | 1 | 3 | 0 | 2 | 3 | 2 | 3 | 3 | 4 | 3 | 1 | 3 | 4 | 2 | 3 | 0 | 3 |
| 418 | Q | 4 | 3 | 2 | 2 | 5 | 2 | 6 | 6 | 6 | 5 | 6 | 3 | 1 | 0 | 6 | 4 | 3 | 4 | 5 | 7 |
| 419 | Q | 1 | 2 | 1 | 0 | 2 | 1 | 1 | 2 | 4 | 4 | 3 | 2 | 1 | 0 | 5 | 2 | 1 | 2 | 3 | 3 |
| 420 | G | 2 | 2 | 1 | 2 | 2 | 3 | 0 | 1 | 3 | 3 | 3 | 3 | 3 | 4 | 0 | 3 | 3 | 4 | 3 | 3 |
| 421 | N | 1 | 3 | 1 | 1 | 4 | 1 | 3 | 5 | 4 | 4 | 5 | 0 | 2 | 2 | 7 | 3 | 3 | 5 | 4 | 4 |
| 422 | V | 1 | 0 | 1 | 0 | 4 | 1 | 2 | 0 | 2 | 4 | 4 | 2 | 1 | 3 | 4 | 1 | 1 | 0 | 4 | 4 |
| 423 | F | 3 | 1 | 2 | 2 | 0 | 2 | 5 | 2 | 3 | 4 | 2 | 3 | 1 | 3 | 2 | 2 | 3 | 3 | 5 | 5 |
| 424 | S | 4 | 3 | 0 | 2 | 6 | 4 | 4 | 6 | 4 | 7 | 6 | 4 | 2 | 5 | 5 | 0 | 4 | 7 | 6 | 6 |
| 425 | C | 6 | 0 | 3 | 3 | 6 | 5 | 6 | 6 | 6 | 6 | 6 | 6 | 5 | 5 | 6 | 7 | 6 | 7 | 6 | 6 |

TABLE 67-continued

| EU No. | AK072 sequence | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 426 | S | 4 | 3 | 3 | 3 | 5 | 3 | 3 | 5 | 3 | 6 | 6 | 5 | 4 | 4 | 4 | 0 | 4 | 4 | 5 | 5 |
| 427 | V | 3 | 3 | 1 | 1 | 4 | 2 | 3 | 5 | 3 | 5 | 5 | 3 | 3 | 3 | 4 | 3 | 3 | 0 | 3 | 3 |
| 428 | M | 2 | 2 | 1 | 1 | 4 | 2 | 3 | 6 | 1 | 5 | 0 | 3 | 2 | 3 | 2 | 3 | 3 | 6 | 3 | 5 |
| 429 | H | 6 | 5 | 2 | 3 | 7 | 4 | 0 | 7 | 4 | 8 | 7 | 5 | 5 | 4 | 5 | 4 | 4 | 8 | 7 | 8 |
| 430 | E | 7 | 6 | 6 | 0 | 8 | 6 | 7 | 9 | 8 | 9 | 9 | 7 | 7 | 6 | 9 | 9 | 9 | 8 | 8 | 8 |
| 431 | A | 0 | 5 | 3 | 2 | 7 | 6 | 6 | 7 | 5 | 7 | 7 | 6 | 5 | 4 | 6 | 5 | 6 | 6 | 7 | 7 |
| 432 | L | 3 | 3 | 3 | 2 | 5 | 4 | 5 | 5 | 4 | 0 | 6 | 6 | 4 | 5 | 5 | 5 | 4 | 5 | 5 | 5 |
| 433 | H | 5 | 5 | 1 | 2 | 6 | 4 | 0 | 7 | 6 | 8 | 8 | 5 | 4 | 6 | 6 | 5 | 5 | 7 | 6 | 6 |
| 434 | N | 5 | 5 | 4 | 4 | 6 | 5 | 7 | 7 | 8 | 8 | 7 | 0 | 5 | 5 | 8 | 6 | 6 | 7 | 6 | 6 |
| 435 | R | 5 | 5 | 3 | 2 | 5 | 4 | 0 | 6 | 6 | 6 | 5 | 2 | 5 | 0 | 5 | 5 | 6 | 5 | 5 | 5 |
| 436 | Y | 7 | 6 | 3 | 5 | 0 | 6 | 5 | 7 | 7 | 7 | 7 | 6 | 5 | 6 | 8 | 6 | 4 | 7 | 7 | 0 |
| 437 | T | 7 | 6 | 4 | 5 | 8 | 8 | 7 | 8 | 8 | 8 | 8 | 8 | 7 | 8 | 8 | 7 | 0 | 8 | 8 | 8 |
| 438 | Q | 6 | 5 | 3 | 2 | 7 | 5 | 7 | 5 | 4 | 5 | 7 | 7 | 5 | 0 | 6 | 6 | 6 | 6 | 6 | 6 |
| 439 | K | 6 | 4 | 3 | 3 | 4 | 4 | 4 | 5 | 0 | 4 | 5 | 5 | 3 | 4 | 5 | 5 | 5 | 4 | 4 | 5 |
| 440 | S | 5 | 4 | 3 | 3 | 3 | 4 | 4 | 5 | 4 | 4 | 4 | 4 | 4 | 4 | 0 | 4 | 4 | 3 | 3 | 3 |
| 441 | L | 4 | 3 | 2 | 3 | 4 | 4 | 4 | 4 | 3 | 0 | 4 | 3 | 3 | 3 | 3 | 4 | 4 | 4 | 4 | 4 |
| 442 | S | 3 | 3 | 2 | 2 | 4 | 3 | 3 | 4 | 3 | 4 | 3 | 3 | 3 | 3 | 4 | 0 | 3 | 3 | 2 | 4 |
| 443 | L | 2 | 2 | 2 | 1 | 2 | 2 | 3 | 2 | 1 | 0 | 2 | 3 | 2 | 3 | 3 | 2 | 2 | 2 | 2 | 2 |
| 444 | S | 2 | 2 | 2 | 2 | 2 | 2 | 2 | 2 | 2 | 2 | 2 | 2 | 2 | 2 | 2 | 0 | 2 | 2 | 1 | 2 |
| 445 | P | 1 | 1 | 1 | 1 | 1 | 1 | 1 | 1 | 1 | 0 | 1 | 1 | 0 | 1 | 1 | 1 | 1 | 1 | 1 | 1 |

TABLE 68

| EU No. | BH076 sequence | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 118 | A | 0 | 0 | 0 | 0 | 1 | 0 | 0 | 0 | 0 | 0 | 0 | 0 | 0 | 0 | 0 | 0 | 0 | 0 | 0 | 0 |
| 119 | S | 0 | 0 | 0 | 0 | 1 | 0 | 0 | 1 | 0 | 1 | 1 | 0 | 0 | 0 | 0 | 0 | 0 | 1 | 1 | 1 |
| 120 | T | 0 | 0 | 0 | 0 | 1 | 0 | 0 | 1 | 0 | 1 | 1 | 0 | 0 | 0 | 0 | 0 | 0 | 1 | 1 | 1 |
| 121 | K | 0 | 0 | 0 | 0 | 1 | 0 | 0 | 0 | 0 | 0 | 0 | 0 | 0 | 0 | 0 | 0 | 0 | 0 | 1 | 0 |
| 122 | G | 0 | 0 | 0 | 0 | 1 | 0 | 0 | 0 | 0 | 0 | 0 | 0 | 0 | 0 | 0 | 0 | 0 | 0 | 0 | 1 |
| 123 | P | 1 | 0 | 0 | 0 | 2 | 0 | 1 | 1 | 1 | 2 | 1 | 0 | 0 | 0 | 2 | 1 | 0 | 1 | 2 | 2 |
| 124 | S | 0 | 0 | 0 | 0 | 2 | 0 | 0 | 2 | 2 | 2 | 2 | 1 | 0 | 1 | 2 | 0 | 0 | 1 | 1 | 1 |
| 125 | V | 0 | 0 | 0 | 0 | 1 | 0 | 0 | 1 | 0 | 1 | 1 | 0 | 0 | 0 | 0 | 0 | 0 | 0 | 1 | 1 |
| 126 | F | 0 | 1 | 0 | 1 | 0 | 0 | 1 | 2 | 2 | 2 | 2 | 2 | 0 | 1 | 2 | 1 | 1 | 2 | 3 | 2 |
| 127 | P | 4 | 3 | 3 | 3 | 4 | 3 | 3 | 4 | 2 | 4 | 4 | 3 | 0 | 3 | 2 | 3 | 3 | 4 | 4 | 4 |
| 178 | L | 1 | 1 | 2 | 2 | 3 | 1 | 2 | 3 | 4 | 0 | 3 | 2 | 1 | 2 | 3 | 2 | 1 | 3 | 3 | 3 |
| 129 | A | 0 | 3 | 3 | 3 | 4 | 3 | 3 | 3 | 3 | 3 | 3 | 3 | 2 | 4 | 3 | 3 | 3 | 3 | 4 | 3 |
| 130 | P | 3 | 3 | 3 | 3 | 4 | 3 | 3 | 4 | 3 | 4 | 4 | 3 | 0 | 3 | 4 | 3 | 3 | 3 | 5 | 4 |
| 131 | S | 3 | 3 | 3 | 3 | 4 | 3 | 2 | 4 | 3 | 4 | 4 | 3 | 3 | 3 | 3 | 0 | 3 | 4 | 3 | 4 |
| 132 | S | 3 | 3 | 3 | 3 | 4 | 3 | 3 | 4 | 3 | 4 | 4 | 3 | 3 | 3 | 3 | 0 | 3 | 4 | 4 | 4 |
| 133 | K | 3 | 2 | 3 | 3 | 3 | 2 | 3 | 3 | 0 | 3 | 3 | 3 | 3 | 3 | 3 | 3 | 3 | 3 | 3 | 3 |
| 134 | S | 3 | 3 | 3 | 3 | 4 | 3 | 3 | 4 | 3 | 4 | 5 | 3 | 3 | 3 | 3 | 0 | 3 | 4 | 4 | 4 |
| 135 | T | 2 | 2 | 2 | 1 | 3 | 2 | 2 | 4 | 2 | 4 | 4 | 2 | 2 | 2 | 3 | 2 | 0 | 2 | 3 | 3 |
| 136 | S | 1 | 1 | 1 | 1 | 2 | 1 | 1 | 2 | 1 | 2 | 3 | 1 | 1 | 1 | 1 | 0 | 1 | 1 | 2 | 2 |
| 137 | G | 1 | 1 | 1 | 1 | 2 | 0 | 1 | 2 | 1 | 3 | 2 | 1 | 1 | 1 | 1 | 1 | 1 | 2 | 2 | 2 |
| 138 | G | 0 | 1 | 0 | 0 | 1 | 0 | 0 | 1 | 1 | 2 | 1 | 0 | 0 | 0 | 1 | 0 | 0 | 1 | 1 | 1 |
| 139 | T | 1 | 1 | 0 | 0 | 3 | 0 | 1 | 3 | 1 | 3 | 3 | 0 | 0 | 1 | 1 | 0 | 0 | 3 | 1 | 3 |
| 140 | A | 0 | 0 | 0 | 0 | 1 | 0 | 1 | 1 | 1 | 1 | 1 | 0 | 0 | 0 | 1 | 0 | 0 | 1 | 1 | 1 |
| 141 | A | 0 | 0 | 0 | 0 | 2 | 0 | 0 | 2 | 0 | 1 | 1 | 0 | 0 | 0 | 0 | 0 | 0 | 0 | 2 | 2 |
| 142 | L | 0 | 0 | 0 | 0 | 0 | 0 | 0 | 0 | 0 | 0 | 0 | 0 | 0 | 0 | 0 | 1 | 0 | 0 | 0 | 1 |
| 143 | G | 2 | 0 | 1 | 1 | 2 | 0 | 1 | 2 | 1 | 2 | 2 | 1 | 1 | 2 | 2 | 1 | 1 | 2 | 2 | 2 |
| 144 | C | 2 | 0 | 0 | 1 | 4 | 2 | 3 | 5 | 2 | 5 | 5 | 2 | 2 | 3 | 3 | 2 | 1 | 4 | 4 | 4 |
| 145 | L | 0 | 0 | 1 | 1 | 0 | 0 | 1 | 0 | 1 | 0 | 0 | 0 | 0 | 1 | 1 | 1 | 0 | 0 | 1 | 0 |
| 146 | V | 0 | 0 | 0 | 0 | 2 | 0 | 1 | 0 | 1 | 2 | 1 | 1 | 0 | 1 | 1 | 1 | 1 | 0 | 1 | 1 |
| 147 | K | 0 | 0 | 0 | 0 | 3 | 0 | 1 | 3 | 0 | 3 | 3 | 1 | 1 | 1 | 2 | 1 | 1 | 3 | 1 | 3 |
| 148 | D | 2 | 2 | 0 | 2 | 4 | 2 | 3 | 4 | 4 | 4 | 4 | 2 | 2 | 3 | 3 | 3 | 3 | 4 | 4 | 4 |
| 149 | Y | 1 | 0 | 1 | 0 | 1 | 0 | 2 | 1 | 3 | 3 | 2 | 1 | 0 | 3 | 2 | 1 | 2 | 2 | 2 | 0 |
| 150 | F | 2 | 1 | 2 | 2 | 0 | 1 | 3 | 2 | 3 | 2 | 1 | 2 | 2 | 3 | 4 | 4 | 3 | 2 | 1 | 2 |
| 151 | P | 3 | 2 | 2 | 2 | 3 | 2 | 3 | 4 | 4 | 5 | 5 | 3 | 0 | 4 | 3 | 3 | 2 | 2 | 3 | 3 |
| 152 | E | 4 | 2 | 1 | 0 | 4 | 2 | 4 | 3 | 3 | 3 | 3 | 3 | 2 | 3 | 4 | 5 | 2 | 3 | 4 | 4 |
| 153 | P | 3 | 2 | 3 | 3 | 3 | 1 | 3 | 5 | 2 | 5 | 5 | 1 | 0 | 2 | 4 | 3 | 2 | 3 | 3 | 4 |
| 154 | V | 2 | 1 | 1 | 1 | 2 | 1 | 2 | 2 | 2 | 2 | 2 | 1 | 1 | 2 | 2 | 1 | 0 | 1 | 2 | 2 |
| 155 | T | 3 | 2 | 2 | 2 | 4 | 2 | 3 | 4 | 3 | 4 | 4 | 2 | 2 | 2 | 3 | 3 | 0 | 4 | 4 | 4 |
| 156 | V | 2 | 2 | 1 | 2 | 3 | 2 | 2 | 3 | 2 | 3 | 3 | 2 | 2 | 2 | 3 | 2 | 2 | 0 | 3 | 3 |
| 157 | S | 3 | 3 | 2 | 2 | 5 | 3 | 3 | 4 | 2 | 5 | 5 | 2 | 2 | 2 | 3 | 0 | 3 | 5 | 4 | 5 |
| 158 | W | 3 | 3 | 3 | 3 | 3 | 2 | 3 | 3 | 3 | 4 | 3 | 3 | 2 | 3 | 4 | 4 | 4 | 4 | 0 | 3 |
| 159 | N | 2 | 2 | 1 | 2 | 2 | 2 | 2 | 2 | 3 | 2 | 2 | 0 | 1 | 3 | 2 | 2 | 2 | 3 | 2 | 2 |
| 160 | S | 4 | 3 | 2 | 2 | 4 | 4 | 4 | 4 | 4 | 4 | 3 | 3 | 3 | 3 | 0 | 4 | 3 | 4 | 4 | 4 |
| 161 | G | 4 | 3 | 2 | 2 | 5 | 0 | 5 | 5 | 4 | 5 | 5 | 4 | 3 | 4 | 4 | 3 | 3 | 5 | 4 | 5 |
| 162 | A | 0 | 4 | 1 | 1 | 5 | 3 | 5 | 2 | 6 | 5 | 6 | 4 | 3 | 5 | 4 | 5 | 4 | 6 | 5 | 5 |
| 163 | L | 3 | 1 | 1 | 1 | 5 | 3 | 2 | 3 | 3 | 0 | 4 | 3 | 2 | 3 | 3 | 3 | 3 | 3 | 1 | 2 |
| 164 | T | 3 | 3 | 1 | 2 | 4 | 3 | 3 | 5 | 3 | 5 | 5 | 3 | 3 | 3 | 3 | 3 | 0 | 4 | 5 | 4 |
| 165 | S | 3 | 2 | 1 | 1 | 2 | 1 | 3 | 4 | 3 | 3 | 3 | 2 | 3 | 2 | 3 | 0 | 2 | 3 | 2 | 3 |
| 166 | G | 4 | 2 | 1 | 2 | 4 | 0 | 5 | 5 | 3 | 5 | 4 | 4 | 2 | 4 | 6 | 5 | 3 | 5 | 4 | 4 |

TABLE 68-continued

| EU No. | BH076 sequence | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 167 | V | 3 | 3 | 4 | 0 | 4 | 3 | 3 | 3 | 4 | 5 | 5 | 4 | 3 | 4 | 4 | 4 | 3 | 0 | 4 | 4 |
| 168 | H | 2 | 1 | 1 | 1 | 3 | 2 | 0 | 3 | 3 | 3 | 3 | 2 | 1 | 1 | 3 | 1 | 2 | 2 | 2 | 3 |
| 169 | T | 3 | 3 | 2 | 1 | 4 | 3 | 4 | 5 | 3 | 4 | 4 | 4 | 2 | 4 | 5 | 3 | 0 | 4 | 4 | 4 |
| 170 | F | 3 | 1 | 1 | 1 | 0 | 1 | 1 | 3 | 3 | 2 | 3 | 3 | 2 | 3 | 2 | 2 | 2 | 3 | 1 | 3 |
| 171 | P | 5 | 4 | 3 | 3 | 6 | 3 | 6 | 6 | 7 | 6 | 6 | 5 | 0 | 6 | 6 | 4 | 4 | 6 | 5 | 5 |
| 172 | A | 0 | 5 | 0 | 0 | 6 | 3 | 6 | 6 | 5 | 6 | 6 | 4 | 4 | 5 | 7 | 6 | 3 | 6 | 6 | 6 |
| 173 | V | 3 | 2 | 2 | 2 | 7 | 2 | 5 | 6 | 2 | 6 | 6 | 3 | 2 | 5 | 3 | 4 | 3 | 0 | 6 | 5 |
| 174 | L | 4 | 5 | 3 | 4 | 6 | 4 | 4 | 6 | 5 | 0 | 6 | 3 | 2 | 2 | 5 | 4 | 4 | 6 | 6 | 6 |
| 175 | Q | 5 | 4 | 5 | 4 | 5 | 5 | 7 | 6 | 7 | 6 | 6 | 5 | 4 | 0 | 7 | 6 | 6 | 5 | 6 | 6 |
| 176 | S | 7 | 6 | 3 | 4 | 6 | 6 | 5 | 6 | 6 | 6 | 6 | 5 | 5 | 5 | 6 | 0 | 6 | 6 | 6 | 0 |
| 177 | S | 6 | 3 | 3 | 4 | 5 | 4 | 5 | 6 | 5 | 5 | 5 | 5 | 3 | 3 | 5 | 0 | 5 | 6 | 6 | 5 |
| 178 | G | 6 | 7 | 5 | 4 | 6 | 0 | 8 | 8 | 8 | 8 | 8 | 6 | 7 | 7 | 9 | 7 | 7 | 8 | 8 | 8 |
| 179 | L | 4 | 6 | 4 | 2 | 7 | 5 | 6 | 7 | 6 | 0 | 7 | 6 | 5 | 7 | 6 | 6 | 5 | 7 | 7 | 7 |
| 180 | Y | 5 | 4 | 3 | 3 | 6 | 2 | 6 | 6 | 6 | 6 | 6 | 3 | 4 | 4 | 6 | 5 | 4 | 6 | 7 | 0 |
| 181 | S | 6 | 6 | 5 | 3 | 7 | 5 | 6 | 7 | 8 | 7 | 7 | 6 | 7 | 8 | 0 | 7 | 7 | 8 | 8 | 8 |
| 182 | L | 6 | 6 | 3 | 4 | 7 | 5 | 6 | 7 | 5 | 0 | 7 | 6 | 5 | 6 | 8 | 7 | 5 | 7 | 6 | 7 |
| 183 | S | 6 | 5 | 4 | 3 | 6 | 6 | 5 | 6 | 7 | 6 | 6 | 5 | 6 | 7 | 7 | 0 | 6 | 6 | 6 | 6 |
| 184 | S | 6 | 5 | 4 | 4 | 7 | 5 | 7 | 8 | 7 | 7 | 7 | 5 | 4 | 6 | 7 | 0 | 6 | 6 | 6 | 6 |
| 185 | V | 4 | 5 | 4 | 3 | 6 | 4 | 5 | 6 | 5 | 6 | 6 | 6 | 3 | 5 | 5 | 5 | 5 | 0 | 5 | 6 |
| 186 | V | 4 | 4 | 4 | 5 | 5 | 4 | 5 | 5 | 5 | 5 | 5 | 4 | 4 | 4 | 5 | 5 | 4 | 0 | 5 | 6 |
| 187 | T | 6 | 5 | 6 | 5 | 8 | 5 | 6 | 8 | 6 | 8 | 8 | 5 | 5 | 7 | 6 | 5 | 0 | 8 | 7 | 8 |
| 188 | V | 4 | 3 | 4 | 4 | 4 | 4 | 4 | 4 | 4 | 4 | 4 | 3 | 3 | 3 | 5 | 4 | 4 | 0 | 4 | 4 |
| 189 | P | 6 | 4 | 4 | 4 | 5 | 4 | 5 | 7 | 6 | 7 | 7 | 4 | 0 | 5 | 6 | 4 | 3 | 5 | 6 | 7 |
| 190 | S | 2 | 3 | 2 | 2 | 3 | 2 | 2 | 3 | 2 | 3 | 3 | 2 | 2 | 3 | 2 | 0 | 2 | 3 | 2 | 3 |
| 191 | S | 2 | 2 | 2 | 2 | 3 | 2 | 2 | 3 | 3 | 4 | 3 | 2 | 2 | 2 | 4 | 0 | 2 | 3 | 3 | 2 |
| 192 | S | 2 | 1 | 1 | 1 | 3 | 1 | 3 | 3 | 2 | 3 | 3 | 2 | 1 | 2 | 3 | 0 | 1 | 3 | 2 | 3 |
| 193 | L | 1 | 1 | 2 | 1 | 2 | 1 | 2 | 2 | 2 | 0 | 1 | 3 | 1 | 2 | 2 | 1 | 2 | 1 | 2 | 2 |
| 194 | G | 3 | 2 | 1 | 2 | 6 | 0 | 3 | 6 | 4 | 6 | 6 | 3 | 2 | 3 | 4 | 2 | 1 | 5 | 5 | 6 |
| 195 | T | 1 | 0 | 0 | 0 | 4 | 0 | 3 | 4 | 2 | 4 | 5 | 1 | 0 | 3 | 2 | 0 | 0 | 3 | 2 | 4 |
| 196 | Q | 2 | 1 | 1 | 0 | 3 | 2 | 1 | 3 | 2 | 4 | 3 | 2 | 1 | 0 | 4 | 2 | 1 | 3 | 3 | 3 |
| 197 | T | 1 | 1 | 1 | 1 | 2 | 1 | 1 | 5 | 1 | 3 | 3 | 2 | 0 | 1 | 2 | 1 | 0 | 3 | 4 | 3 |
| 198 | Y | 2 | 1 | 0 | 0 | 2 | 2 | 1 | 3 | 2 | 3 | 4 | 2 | 2 | 3 | 2 | 1 | 2 | 3 | 2 | 0 |
| 199 | I | 2 | 1 | 1 | 2 | 3 | 2 | 2 | 0 | 2 | 3 | 3 | 2 | 1 | 2 | 2 | 3 | 0 | 3 | 3 | 3 |
| 200 | G | 5 | 0 | 2 | 3 | 6 | 4 | 6 | 7 | 6 | 6 | 6 | 5 | 6 | 6 | 6 | 5 | 5 | 7 | 4 | 6 |
| 201 | N | 5 | 3 | 3 | 3 | 5 | 4 | 5 | 4 | 4 | 5 | 5 | 0 | 1 | 4 | 5 | 4 | 4 | 3 | 4 | 5 |
| 202 | V | 4 | 3 | 2 | 2 | 5 | 3 | 6 | 5 | 5 | 6 | 5 | 5 | 2 | 6 | 5 | 4 | 3 | 0 | 4 | 5 |
| 203 | N | 4 | 3 | 3 | 2 | 5 | 2 | 5 | 6 | 5 | 5 | 5 | 0 | 3 | 3 | 6 | 5 | 5 | 5 | 4 | 5 |
| 204 | H | 5 | 3 | 4 | 4 | 5 | 5 | 0 | 6 | 5 | 6 | 6 | 5 | 3 | 6 | 4 | 5 | 3 | 6 | 4 | 5 |
| 205 | K | 4 | 4 | 2 | 4 | 5 | 4 | 4 | 6 | 0 | 6 | 5 | 5 | 2 | 4 | 5 | 4 | 4 | 5 | 5 | 5 |
| 206 | P | 5 | 3 | 2 | 2 | 5 | 4 | 3 | 5 | 5 | 6 | 5 | 6 | 0 | 5 | 6 | 5 | 5 | 4 | 5 | 5 |
| 207 | S | 4 | 3 | 3 | 2 | 4 | 2 | 4 | 5 | 3 | 4 | 4 | 3 | 4 | 4 | 5 | 0 | 4 | 4 | 3 | 4 |
| 208 | N | 3 | 2 | 2 | 2 | 4 | 3 | 2 | 4 | 2 | 5 | 4 | 0 | 3 | 3 | 3 | 2 | 2 | 4 | 5 | 4 |
| 209 | T | 2 | 2 | 1 | 1 | 3 | 2 | 2 | 3 | 3 | 3 | 3 | 2 | 2 | 3 | 2 | 0 | 3 | 2 | 3 |
| 210 | K | 2 | 1 | 1 | 1 | 1 | 1 | 1 | 0 | 2 | 1 | 1 | 1 | 1 | 1 | 1 | 1 | 2 | 1 |
| 211 | V | 2 | 1 | 1 | 1 | 1 | 1 | 2 | 2 | 2 | 2 | 1 | 2 | 2 | 2 | 2 | 1 | 0 | 1 | 1 |
| 212 | D | 2 | 1 | 0 | 0 | 4 | 1 | 2 | 3 | 1 | 3 | 3 | 1 | 1 | 2 | 3 | 1 | 1 | 3 | 2 | 3 |
| 213 | K | 0 | 0 | 0 | 0 | 2 | 0 | 2 | 2 | 0 | 1 | 1 | 1 | 0 | 1 | 1 | 0 | 1 | 1 | 2 | 2 |
| 214 | K | 0 | 0 | 0 | 0 | 0 | 0 | 0 | 1 | 0 | 0 | 0 | 0 | 0 | 1 | 0 | 0 | 0 | 1 | 0 | 0 |
| 215 | V | 0 | 0 | 0 | 0 | 0 | 0 | 0 | 0 | 1 | 0 | 0 | 0 | 0 | 0 | 0 | 0 | 0 | 0 | 0 | 0 |
| 216 | E | 1 | 1 | 0 | 0 | 2 | 1 | 1 | 3 | 2 | 3 | 2 | 1 | 1 | 2 | 2 | 1 | 2 | 3 | 1 | 2 |
| 217 | P | 0 | 0 | 0 | 0 | 2 | 0 | 1 | 2 | 1 | 2 | 2 | 0 | 0 | 1 | 1 | 0 | 0 | 2 | 2 | 2 |
| 218 | K | 0 | 0 | 0 | 0 | 2 | 0 | 0 | 2 | 0 | 2 | 2 | 0 | 0 | 1 | 0 | 1 | 0 | 2 | 2 | 2 |
| 219 | S | 1 | 0 | 0 | 0 | 0 | 0 | 0 | 1 | 0 | 1 | 0 | 0 | 1 | 0 | 0 | 0 | 0 | 0 | 0 | 0 |
| 220 | C | 0 | 0 | 0 | 0 | 0 | 0 | 1 | 1 | 2 | 1 | 1 | 1 | 1 | 1 | 3 | 2 | 1 | 0 | 1 | 1 |
| 221 | D | 2 | 0 | 0 | 0 | 3 | 2 | 1 | 1 | 1 | 2 | 3 | 2 | 0 | 1 | 2 | 1 | 0 | 1 | 3 | 3 |
| 222 | K | 0 | 0 | 0 | 0 | 0 | 0 | 1 | 1 | 0 | 0 | 0 | 1 | 0 | 1 | 0 | 0 | 0 | 0 | 0 | 0 |
| 223 | T | 0 | 0 | 0 | 0 | 2 | 0 | 0 | 0 | 0 | 0 | 0 | 0 | 0 | 1 | 1 | 0 | 0 | 1 | 0 | 1 |
| 224 | H | 0 | 0 | 0 | 0 | 0 | 0 | 0 | 0 | 0 | 0 | 0 | 0 | 0 | 0 | 0 | 0 | 0 | 0 | 0 | 0 |
| 225 | T | 0 | 0 | 0 | 0 | 0 | 0 | 0 | 0 | 1 | 0 | 0 | 0 | 0 | 0 | 1 | 0 | 0 | 0 | 1 | 1 |
| 226 | C | 0 | 0 | 0 | 0 | 1 | 0 | 0 | 1 | 0 | 0 | 0 | 1 | 0 | 0 | 0 | 0 | 0 | 0 | 1 | 1 |
| 227 | P | 0 | 1 | 0 | 0 | 1 | 1 | 0 | 1 | 1 | 1 | 1 | 0 | 1 | 1 | 1 | 0 | 1 | 1 | 1 | 1 |
| 228 | P | 0 | 0 | 0 | 0 | 2 | 0 | 1 | 0 | 0 | 1 | 0 | 0 | 0 | 0 | 0 | 0 | 0 | 0 | 1 | 1 |
| 229 | C | 0 | 0 | 0 | 0 | 0 | 0 | 0 | 0 | 0 | 0 | 0 | 0 | 0 | 0 | 1 | 1 | 0 | 0 | 0 | 0 |
| 230 | P | 0 | 0 | 0 | 0 | 0 | 0 | 0 | 1 | 0 | 1 | 1 | 0 | 0 | 0 | 0 | 0 | 0 | 1 | 0 | 0 |
| 231 | A | 0 | 0 | 0 | 0 | 0 | 0 | 0 | 0 | 0 | 0 | 0 | 0 | 0 | 0 | 0 | 0 | 0 | 0 | 0 | 0 |
| 232 | P | 1 | 1 | 1 | 0 | 1 | 1 | 2 | 1 | 1 | 1 | 1 | 0 | 1 | 1 | 1 | 1 | 1 | 1 | 1 | 1 |
| 233 | E | 1 | 1 | 1 | 0 | 3 | 1 | 2 | 3 | 1 | 3 | 3 | 2 | 0 | 1 | 2 | 2 | 1 | 3 | 2 | 2 |
| 234 | L | 1 | 1 | 0 | 0 | 0 | 1 | 2 | 2 | 2 | 0 | 2 | 0 | 0 | 0 | 2 | 1 | 1 | 2 | 2 | 2 |
| 235 | L | 1 | 1 | 1 | 1 | 1 | 1 | 1 | 2 | 1 | 0 | 1 | 1 | 1 | 1 | 1 | 1 | 1 | 1 | 1 | 1 |
| 236 | G | 2 | 2 | 1 | 2 | 3 | 0 | 1 | 2 | 2 | 2 | 2 | 2 | 2 | 2 | 2 | 2 | 2 | 2 | 3 | 3 |
| 237 | G | 2 | 1 | 1 | 1 | 1 | 0 | 1 | 1 | 1 | 1 | 1 | 2 | 2 | 2 | 1 | 2 | 1 | 1 | 1 | 1 |
| 238 | P | 3 | 1 | 2 | 1 | 4 | 1 | 3 | 4 | 2 | 4 | 4 | 3 | 0 | 3 | 3 | 3 | 2 | 4 | 4 | 4 |
| 239 | S | 2 | 1 | 1 | 1 | 3 | 3 | 2 | 3 | 3 | 3 | 3 | 2 | 2 | 2 | 3 | 0 | 3 | 3 | 3 | 3 |
| 240 | V | 2 | 1 | 1 | 1 | 3 | 1 | 2 | 4 | 4 | 4 | 4 | 1 | 1 | 2 | 3 | 1 | 1 | 0 | 2 | 3 |
| 241 | F | 3 | 1 | 1 | 1 | 0 | 1 | 2 | 5 | 4 | 5 | 5 | 1 | 1 | 1 | 3 | 1 | 1 | 5 | 4 | 5 |
| 242 | L | 2 | 2 | 2 | 1 | 2 | 2 | 2 | 3 | 2 | 0 | 3 | 2 | 2 | 3 | 3 | 2 | 2 | 2 | 2 | 2 |
| 243 | F | 4 | 3 | 2 | 2 | 0 | 2 | 4 | 4 | 4 | 4 | 4 | 3 | 3 | 4 | 4 | 5 | 4 | 4 | 2 | 4 |
| 244 | P | 2 | 1 | 2 | 2 | 3 | 2 | 3 | 3 | 3 | 3 | 3 | 4 | 0 | 3 | 5 | 3 | 3 | 3 | 3 | 3 |

TABLE 68-continued

| EU No. | BH076 sequence | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 245 | P | 4 | 1 | 1 | 0 | 4 | 3 | 4 | 4 | 3 | 5 | 4 | 3 | 0 | 2 | 3 | 3 | 2 | 4 | 4 | 4 |
| 246 | K | 2 | 0 | 2 | 1 | 2 | 1 | 2 | 3 | 0 | 4 | 3 | 1 | 2 | 1 | 3 | 2 | 2 | 3 | 3 | 3 |
| 247 | P | 2 | 2 | 1 | 1 | 3 | 2 | 2 | 3 | 2 | 4 | 4 | 2 | 0 | 2 | 4 | 2 | 2 | 2 | 2 | 3 |
| 248 | K | 3 | 1 | 2 | 1 | 4 | 2 | 4 | 4 | 0 | 4 | 4 | 1 | 1 | 3 | 4 | 3 | 2 | 4 | 4 | 4 |
| 249 | D | 4 | 4 | 0 | 3 | 5 | 4 | 4 | 5 | 6 | 5 | 5 | 4 | 3 | 4 | 6 | 4 | 4 | 5 | 6 | 6 |
| 250 | T | 2 | 2 | 2 | 2 | 2 | 2 | 2 | 2 | 3 | 3 | 3 | 2 | 2 | 2 | 3 | 2 | 0 | 2 | 3 | 2 |
| 251 | L | 2 | 2 | 1 | 1 | 3 | 1 | 2 | 2 | 2 | 0 | 3 | 3 | 1 | 1 | 3 | 3 | 3 | 2 | 2 | 3 |
| 252 | M | 3 | 3 | 1 | 2 | 3 | 3 | 3 | 3 | 3 | 3 | 0 | 3 | 3 | 3 | 4 | 3 | 3 | 3 | 3 | 4 |
| 253 | I | 4 | 3 | 3 | 2 | 3 | 2 | 3 | 0 | 4 | 3 | 3 | 4 | 3 | 3 | 4 | 4 | 4 | 3 | 3 | 3 |
| 254 | S | 4 | 3 | 3 | 3 | 4 | 3 | 3 | 4 | 3 | 4 | 4 | 4 | 3 | 4 | 3 | 0 | 4 | 4 | 4 | 4 |
| 255 | R | 3 | 2 | 2 | 2 | 4 | 2 | 4 | 5 | 3 | 4 | 4 | 3 | 3 | 3 | 0 | 4 | 3 | 4 | 3 | 3 |
| 256 | T | 3 | 3 | 3 | 3 | 5 | 3 | 5 | 5 | 3 | 5 | 5 | 3 | 3 | 4 | 3 | 4 | 0 | 5 | 5 | 5 |
| 257 | P | 4 | 3 | 3 | 2 | 5 | 4 | 4 | 5 | 3 | 5 | 5 | 4 | 0 | 5 | 3 | 4 | 4 | 5 | 5 | 5 |
| 258 | E | 4 | 3 | 3 | 0 | 4 | 3 | 3 | 4 | 5 | 4 | 5 | 4 | 4 | 3 | 4 | 4 | 4 | 5 | 4 | 4 |
| 259 | V | 3 | 3 | 3 | 3 | 4 | 3 | 3 | 4 | 3 | 4 | 4 | 3 | 3 | 3 | 4 | 3 | 3 | 0 | 4 | 4 |
| 260 | T | 3 | 3 | 3 | 3 | 4 | 3 | 3 | 4 | 4 | 4 | 4 | 3 | 2 | 3 | 4 | 3 | 0 | 4 | 4 | 4 |
| 261 | C | 3 | 0 | 1 | 1 | 4 | 2 | 3 | 5 | 3 | 4 | 4 | 2 | 2 | 3 | 3 | 2 | 2 | 4 | 3 | 4 |
| 262 | V | 0 | 1 | 0 | 0 | 1 | 0 | 1 | 2 | 1 | 1 | 1 | 1 | 0 | 1 | 1 | 1 | 1 | 0 | 2 | 1 |
| 263 | V | 2 | 1 | 1 | 1 | 1 | 1 | 1 | 1 | 1 | 1 | 1 | 1 | 0 | 1 | 1 | 1 | 1 | 0 | 1 | 1 |
| 264 | V | 1 | 1 | 1 | 1 | 1 | 1 | 0 | 1 | 1 | 1 | 1 | 1 | 1 | 1 | 2 | 1 | 1 | 0 | 0 | 1 |
| 265 | D | 3 | 2 | 0 | 1 | 3 | 2 | 2 | 3 | 2 | 3 | 3 | 2 | 1 | 3 | 3 | 3 | 2 | 3 | 3 | 3 |
| 266 | V | 1 | 1 | 0 | 0 | 2 | 1 | 2 | 1 | 2 | 1 | 1 | 2 | 1 | 1 | 2 | 1 | 1 | 0 | 1 | 2 |
| 267 | S | 0 | 2 | 2 | 1 | 2 | 0 | 2 | 2 | 1 | 2 | 2 | 2 | 1 | 2 | 3 | 0 | 1 | 2 | 1 | 2 |
| 268 | H | 1 | 0 | 1 | 0 | 2 | 2 | 0 | 3 | 1 | 3 | 3 | 1 | 3 | 1 | 2 | 2 | 1 | 3 | 2 | 2 |
| 269 | E | 3 | 1 | 1 | 0 | 3 | 2 | 2 | 3 | 2 | 3 | 3 | 2 | 2 | 2 | 3 | 2 | 2 | 3 | 3 | 3 |
| 270 | E | 1 | 0 | 0 | 0 | 1 | 0 | 2 | 2 | 1 | 2 | 2 | 0 | 1 | 0 | 2 | 1 | 0 | 1 | 0 | 1 |
| 271 | P | 0 | 0 | 0 | 0 | 1 | 0 | 1 | 1 | 0 | 1 | 1 | 1 | 0 | 1 | 0 | 0 | 0 | 1 | 1 | 0 |
| 272 | E | 0 | 0 | 0 | 0 | 2 | 0 | 0 | 2 | 0 | 1 | 2 | 0 | 0 | 0 | 2 | 0 | 0 | 1 | 1 | 2 |
| 273 | V | 0 | 0 | 0 | 0 | 0 | 0 | 0 | 0 | 0 | 0 | 0 | 0 | 0 | 0 | 0 | 0 | 0 | 0 | 1 | 0 |
| 274 | K | 1 | 1 | 0 | 0 | 2 | 1 | 1 | 1 | 0 | 1 | 1 | 0 | 0 | 0 | 1 | 1 | 1 | 0 | 1 | 2 |
| 275 | F | 0 | 0 | 0 | 0 | 0 | 0 | 0 | 1 | 1 | 1 | 1 | 0 | 0 | 0 | 0 | 0 | 0 | 1 | 1 | 1 |
| 276 | N | 1 | 1 | 1 | 1 | 3 | 1 | 2 | 3 | 1 | 3 | 3 | 0 | 1 | 2 | 2 | 2 | 2 | 3 | 3 | 3 |
| 277 | W | 1 | 1 | 0 | 0 | 2 | 1 | 1 | 2 | 2 | 2 | 2 | 1 | 0 | 1 | 2 | 2 | 2 | 2 | 0 | 2 |
| 278 | Y | 2 | 1 | 1 | 0 | 2 | 1 | 2 | 2 | 3 | 3 | 2 | 2 | 2 | 3 | 3 | 3 | 3 | 3 | 2 | 0 |
| 279 | V | 2 | 2 | 1 | 1 | 2 | 2 | 2 | 2 | 2 | 2 | 2 | 2 | 2 | 3 | 2 | 2 | 2 | 0 | 2 | 2 |
| 280 | D | 4 | 3 | 0 | 2 | 6 | 3 | 4 | 5 | 6 | 5 | 5 | 3 | 2 | 5 | 6 | 4 | 4 | 5 | 5 | 7 |
| 281 | G | 3 | 3 | 2 | 2 | 3 | 0 | 3 | 4 | 3 | 5 | 5 | 3 | 2 | 3 | 4 | 3 | 2 | 3 | 3 | 3 |
| 282 | V | 3 | 2 | 1 | 2 | 2 | 2 | 3 | 2 | 3 | 2 | 0 | 2 | 3 | 2 | 4 | 3 | 2 | 0 | 2 | 2 |
| 283 | E | 4 | 3 | 2 | 0 | 6 | 4 | 3 | 6 | 5 | 7 | 6 | 4 | 4 | 4 | 7 | 4 | 4 | 7 | 5 | 6 |
| 284 | V | 3 | 2 | 1 | 1 | 3 | 2 | 2 | 3 | 3 | 4 | 3 | 4 | 2 | 2 | 2 | 2 | 2 | 0 | 3 | 3 |
| 285 | H | 4 | 3 | 2 | 2 | 4 | 3 | 0 | 4 | 3 | 4 | 4 | 2 | 4 | 3 | 3 | 3 | 2 | 4 | 3 | 4 |
| 286 | N | 3 | 3 | 2 | 2 | 4 | 3 | 3 | 4 | 3 | 5 | 4 | 0 | 3 | 3 | 4 | 3 | 3 | 3 | 4 | 4 |
| 287 | A | 0 | 2 | 2 | 1 | 2 | 2 | 2 | 2 | 3 | 2 | 2 | 2 | 1 | 2 | 3 | 2 | 1 | 2 | 3 | 3 |
| 288 | K | 1 | 0 | 0 | 0 | 2 | 1 | 3 | 3 | 0 | 3 | 3 | 3 | 2 | 1 | 2 | 2 | 2 | 3 | 2 | 2 |
| 289 | T | 2 | 1 | 2 | 2 | 3 | 2 | 4 | 3 | 4 | 3 | 3 | 3 | 1 | 3 | 4 | 2 | 0 | 3 | 2 | 3 |
| 290 | K | 1 | 1 | 1 | 0 | 3 | 1 | 2 | 4 | 0 | 4 | 3 | 2 | 2 | 2 | 2 | 1 | 3 | 3 | 3 | 4 |
| 291 | P | 1 | 2 | 1 | 2 | 5 | 1 | 3 | 2 | 2 | 0 | 3 | 1 | 0 | 2 | 3 | 2 | 2 | 2 | 1 | 3 |
| 292 | R | 1 | 2 | 1 | 1 | 3 | 1 | 2 | 3 | 1 | 3 | 3 | 1 | 1 | 1 | 0 | 2 | 1 | 3 | 1 | 3 |
| 293 | E | 2 | 1 | 2 | 0 | 4 | 2 | 2 | 4 | 3 | 3 | 4 | 2 | 2 | 2 | 3 | 2 | 3 | 4 | 4 | 4 |
| 294 | E | 3 | 3 | 1 | 0 | 4 | 2 | 3 | 5 | 4 | 5 | 4 | 2 | 4 | 4 | 4 | 3 | 5 | 3 | 4 | 4 |
| 295 | Q | 0 | 0 | 0 | 0 | 1 | 0 | 0 | 2 | 0 | 2 | 2 | 0 | 0 | 0 | 0 | 0 | 0 | 2 | 1 | 2 |
| 296 | Y | 0 | 0 | 0 | 0 | 0 | 0 | 1 | 2 | 2 | 1 | 1 | 0 | 0 | 0 | 1 | 1 | 0 | 1 | 2 | 0 |
| 297 | N | 3 | 2 | 1 | 1 | 3 | 1 | 1 | 3 | 3 | 3 | 3 | 0 | 1 | 1 | 2 | 2 | 1 | 3 | 3 | 3 |
| 298 | S | 2 | 1 | 1 | 1 | 4 | 1 | 1 | 4 | 4 | 4 | 4 | 2 | 1 | 2 | 4 | 0 | 1 | 4 | 3 | 4 |
| 299 | T | 3 | 4 | 2 | 2 | 3 | 3 | 3 | 4 | 5 | 4 | 4 | 3 | 3 | 2 | 5 | 2 | 0 | 3 | 3 | 3 |
| 300 | Y | 5 | 3 | 1 | 2 | 0 | 4 | 3 | 3 | 4 | 4 | 4 | 3 | 3 | 4 | 5 | 5 | 5 | 4 | 3 | 0 |
| 301 | R | 4 | 4 | 1 | 2 | 5 | 3 | 4 | 4 | 3 | 5 | 4 | 3 | 4 | 4 | 0 | 3 | 3 | 4 | 5 | 5 |
| 302 | V | 5 | 4 | 3 | 3 | 4 | 4 | 4 | 4 | 4 | 4 | 4 | 5 | 3 | 4 | 5 | 5 | 4 | 0 | 4 | 4 |
| 303 | V | 4 | 4 | 4 | 3 | 5 | 4 | 4 | 6 | 6 | 6 | 6 | 5 | 4 | 4 | 4 | 4 | 5 | 0 | 7 | 6 |
| 304 | S | 5 | 5 | 4 | 4 | 6 | 5 | 6 | 8 | 6 | 6 | 6 | 5 | 5 | 8 | 8 | 0 | 5 | 7 | 6 | 6 |
| 305 | V | 5 | 5 | 4 | 5 | 6 | 5 | 5 | 5 | 6 | 5 | 7 | 5 | 5 | 5 | 5 | 5 | 5 | 0 | 6 | 6 |
| 306 | L | 7 | 6 | 3 | 3 | 7 | 6 | 6 | 7 | 7 | 0 | 7 | 6 | 6 | 6 | 7 | 6 | 6 | 7 | 6 | 7 |
| 307 | T | 7 | 6 | 5 | 5 | 8 | 6 | 7 | 7 | 6 | 8 | 8 | 6 | 7 | 6 | 6 | 6 | 0 | 7 | 8 | 7 |
| 308 | V | 6 | 6 | 5 | 5 | 7 | 5 | 7 | 7 | 5 | 8 | 8 | 6 | 5 | 6 | 5 | 6 | 6 | 0 | 6 | 7 |
| 309 | L | 5 | 4 | 4 | 4 | 6 | 5 | 4 | 7 | 5 | 0 | 6 | 6 | 6 | 5 | 6 | 7 | 6 | 6 | 5 | 6 |
| 310 | H | 5 | 3 | 3 | 2 | 6 | 4 | 0 | 6 | 5 | 6 | 5 | 4 | 5 | 7 | 6 | 5 | 5 | 5 | 5 | 6 |
| 311 | Q | 4 | 4 | 3 | 4 | 5 | 4 | 4 | 5 | 4 | 5 | 5 | 4 | 4 | 0 | 6 | 4 | 4 | 5 | 5 | 5 |
| 312 | D | 4 | 5 | 0 | 2 | 6 | 4 | 5 | 7 | 5 | 8 | 6 | 5 | 4 | 4 | 6 | 5 | 5 | 6 | 7 | 6 |
| 313 | W | 3 | 1 | 1 | 1 | 3 | 3 | 4 | 3 | 2 | 3 | 3 | 2 | 2 | 1 | 3 | 3 | 3 | 3 | 0 | 3 |
| 314 | L | 2 | 2 | 2 | 2 | 3 | 2 | 3 | 3 | 3 | 4 | 0 | 3 | 3 | 3 | 2 | 4 | 2 | 4 | 3 | 3 |
| 315 | N | 2 | 2 | 1 | 1 | 2 | 2 | 3 | 4 | 2 | 4 | 3 | 0 | 2 | 2 | 3 | 3 | 2 | 3 | 2 | 2 |
| 316 | G | 1 | 1 | 0 | 0 | 3 | 0 | 1 | 2 | 0 | 3 | 2 | 2 | 0 | 2 | 2 | 0 | 0 | 2 | 2 | 4 |
| 317 | K | 0 | 0 | -1 | -1 | 1 | 0 | 1 | 1 | 0 | 1 | 0 | 0 | 0 | 0 | 3 | 1 | 0 | 0 | 1 | 1 |
| 318 | E | 1 | 0 | 1 | 0 | 2 | 1 | 1 | 3 | 1 | 3 | 3 | 1 | 1 | 1 | 2 | 3 | 3 | 3 | 3 | 3 |
| 319 | Y | -1 | -1 | -1 | -1 | 0 | -1 | -1 | 0 | 0 | 0 | 0 | -1 | -1 | -1 | 0 | -1 | -1 | 0 | 0 | 0 |
| 320 | K | 1 | -1 | -2 | -2 | 1 | 1 | 0 | 1 | 0 | 1 | 1 | 1 | -1 | 1 | 1 | -1 | -1 | 1 | 0 | 1 |
| 321 | C | 0 | 0 | 0 | 0 | 2 | 0 | 1 | 1 | 1 | 1 | 1 | 0 | 0 | 0 | 2 | 1 | 0 | 1 | 1 | 2 |
| 322 | K | 1 | -1 | -1 | -1 | 1 | 0 | 1 | 2 | 0 | 2 | 2 | 0 | 0 | 0 | 1 | 0 | 1 | 2 | 1 | 2 |

TABLE 68-continued

| EU No. | BH076 sequence | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 323 | V | 0 | 0 | 0 | 0 | 0 | 0 | -1 | 0 | 0 | 0 | 0 | 1 | 0 | 0 | 0 | 0 | 0 | 0 | 0 | 0 |
| 324 | S | 1 | 1 | -2 | -2 | 1 | 0 | 0 | 1 | 2 | 1 | 2 | 0 | 0 | -1 | 3 | 0 | 0 | 2 | 1 | 1 |
| 325 | N | 1 | 0 | -1 | 0 | 1 | 1 | 1 | 1 | 1 | 1 | 1 | 0 | 0 | 1 | 1 | 1 | 1 | 1 | 2 | 1 |
| 326 | D | 1 | 1 | 0 | 1 | 1 | 1 | 2 | 1 | 0 | 1 | 1 | 3 | 1 | 1 | 3 | 1 | 2 | 1 | 1 | 1 |
| 327 | A | 0 | 0 | -1 | -1 | 1 | 0 | 1 | 0 | 1 | 0 | 0 | 0 | -1 | 0 | 1 | 1 | 0 | 0 | 0 | 0 |
| 328 | L | 0 | -1 | -1 | -1 | 0 | 0 | 0 | 0 | 1 | 0 | 1 | 2 | 1 | 1 | 2 | 0 | 2 | 0 | 0 | 1 |
| 329 | P | 0 | 0 | 0 | 0 | 2 | 0 | 0 | 2 | 0 | 2 | 2 | 0 | 0 | 0 | 0 | 1 | 0 | 2 | 2 | 2 |
| 330 | M | -1 | -1 | 0 | 0 | 0 | -1 | -1 | 0 | -1 | 1 | 0 | -1 | -1 | -1 | -1 | -1 | -1 | 0 | 0 | 0 |
| 331 | P | 1 | 1 | 1 | 2 | 3 | 1 | 2 | 3 | 2 | 3 | 4 | 1 | 0 | 1 | 2 | 1 | 1 | 2 | 3 | 3 |
| 332 | I | -1 | -1 | -1 | -1 | 0 | -1 | 0 | 0 | 0 | 0 | 0 | -1 | 0 | 0 | 0 | 0 | 0 | 0 | 0 | 0 |
| 333 | E | 0 | 0 | 0 | 0 | 1 | 0 | 0 | 1 | 0 | 1 | 1 | 0 | -1 | 1 | 0 | 0 | -1 | 1 | 2 | 1 |
| 334 | E | 0 | 0 | 0 | 0 | 3 | 0 | 1 | 1 | 0 | 0 | 0 | 0 | 0 | 0 | 1 | 0 | 0 | 1 | 1 | 1 |
| 335 | T | -1 | 0 | -1 | -1 | 0 | 0 | 1 | 0 | 1 | 0 | 0 | 1 | 0 | 1 | 1 | -1 | 0 | 0 | 0 | 0 |
| 336 | I | 0 | -1 | 0 | 0 | 1 | 0 | -1 | 0 | 0 | 0 | 0 | 0 | 0 | 1 | 0 | 0 | -1 | 0 | 1 | 1 |
| 337 | S | 2 | 1 | -1 | 0 | 3 | 1 | 1 | 2 | 1 | 2 | 2 | 1 | 0 | 1 | 1 | 0 | 1 | 3 | 2 | 2 |
| 338 | K | 1 | 0 | 0 | 0 | 1 | 0 | 1 | 1 | 0 | 1 | 1 | 0 | 1 | 0 | 2 | 0 | 0 | 1 | 1 | 1 |
| 339 | A | 0 | 1 | 0 | 0 | 2 | 0 | 2 | 2 | 2 | 2 | 2 | 1 | 0 | 1 | 2 | 2 | 0 | 2 | 2 | 2 |
| 340 | K | 0 | 0 | 1 | 1 | 2 | 0 | 1 | 2 | 0 | 2 | 2 | 1 | 1 | 1 | 1 | 1 | 1 | 2 | 2 | 2 |
| 341 | G | 2 | 1 | 0 | 0 | 3 | 0 | 2 | 4 | 2 | 2 | 2 | 2 | 2 | 4 | 2 | 2 | 2 | 2 | 3 | 1 | 3 |
| 342 | Q | 3 | 1 | 1 | 1 | 3 | 1 | 3 | 3 | 4 | 3 | 3 | 2 | 2 | 0 | 3 | 3 | 2 | 2 | 4 | 3 |
| 343 | P | 2 | 1 | 1 | 1 | 3 | 2 | 3 | 1 | 2 | 3 | 2 | 3 | 0 | 2 | 2 | 2 | 2 | 2 | 3 | 2 |
| 344 | R | 1 | 1 | 2 | 1 | 2 | 1 | 1 | 1 | 2 | 1 | 1 | 1 | 0 | 1 | 0 | 1 | 1 | 1 | 3 | 1 |
| 345 | E | 3 | 3 | 2 | 0 | 4 | 3 | 2 | 4 | 3 | 4 | 4 | 2 | 3 | 3 | 3 | 3 | 3 | 4 | 4 | 4 |
| 346 | P | 2 | 1 | 1 | 0 | 2 | 1 | 2 | 2 | 2 | 2 | 2 | 1 | 0 | 2 | 2 | 2 | 2 | 2 | 2 | 2 |
| 347 | Q | 2 | 1 | 1 | 1 | 3 | 1 | 1 | 3 | 1 | 3 | 3 | 2 | 1 | 0 | 1 | 2 | 2 | 2 | 1 | 3 |
| 348 | V | 3 | 2 | 0 | 1 | 3 | 2 | 3 | 3 | 4 | 3 | 3 | 2 | 2 | 3 | 4 | 2 | 2 | 0 | 3 | 3 |
| 349 | Y | 3 | 2 | 2 | 2 | 3 | 3 | 3 | 3 | 3 | 3 | 3 |   | 2 | 3 | 3 | 2 | 3 | 3 | 3 | 0 |
| 350 | T | 3 | 3 | 3 | 3 | 3 | 3 | 3 | 3 | 3 | 3 | 3 | 4 | 3 | 3 | 3 | 3 | 0 | 3 | 3 | 3 |
| 351 | L | 2 | 1 | 2 | 0 | 2 | 0 | 2 | 2 | 1 | 0 | 2 | 2 | 1 | 2 | 1 | 2 | 2 | 2 | 2 | 2 |
| 352 | P | 3 | 2 | 2 | 2 | 3 | 2 | 3 | 3 | 3 | 3 | 3 | 3 | 0 | 2 | 3 | 3 | 2 | 3 | 3 | 3 |
| 353 | P | 2 | 2 | 2 | 0 | 2 | 2 | 2 | 2 | 2 | 2 | 2 | 2 | 0 | 2 | 1 | 2 | 2 | 2 | 2 | 2 |
| 354 | S | 2 | 2 | 2 | 2 | 2 | 2 | 2 | 2 | 2 | 2 | 3 | 2 | 2 | 2 | 2 | 0 | 2 | 1 | 1 | 2 |
| 355 | R | 2 | 2 | 2 | 3 | 3 | 2 | 2 | 4 | 2 | 3 | 3 | 2 | 2 | 0 | 0 | 2 | 2 | 3 | 3 | 3 |
| 356 | E | 1 | 1 | 1 | 0 | 3 | 1 | 3 | 3 | 4 | 3 | 3 | 3 | 1 | 3 | 4 | 1 | 2 | 3 | 3 | 3 |
| 357 | E | 2 | 1 | 1 | 0 | 3 | 2 | 2 | 4 | 2 | 4 | 4 | 2 | 1 | 2 | 1 | 2 | 2 | 4 | 3 | 3 |
| 358 | M | 0 | 0 | 0 | 0 | 2 | 0 | 0 | 1 | 1 | 0 | 0 | 0 | 0 | 0 | 1 | 0 | 0 | 0 | 2 | 2 |
| 359 | T | 1 | 0 | 1 | 1 | 2 | 1 | 2 | 2 | 2 | 2 | 2 | 0 | 2 | 2 | 1 | 0 | 2 | 2 | 2 | 2 |
| 360 | K | 1 | 1 | 0 | 0 | 2 | 0 | 1 | 2 | 0 | 3 | 3 | 0 | 0 | 1 | 2 | 0 | 1 | 3 | 2 | 2 |
| 361 | N | 3 | 2 | 1 | 1 | 3 | 2 | 1 | 4 | 3 | 4 | 3 | 0 | 1 | 4 | 3 | 3 | 2 | 4 | 3 | 3 |
| 362 | Q | 2 | 2 | 0 | 0 | 3 | 1 | 2 | 4 | 2 | 4 | 4 | 2 | 2 | 0 | 2 | 2 | 1 | 4 | 3 | 3 |
| 363 | V | 2 | 1 | 1 | 1 | 2 | 2 | 3 | 2 | 4 | 1 | 3 | 2 | 1 | 3 | 4 | 3 | 4 | 0 | 4 | 2 |
| 364 | S | 1 | 0 | 0 | 0 | 4 | 1 | 2 | 4 | 1 | 4 | 3 | 4 | 1 | 2 | 3 | 0 | 2 | 4 | 2 | 4 |
| 365 | L | 3 | 2 | 0 | 1 | 2 | 1 | 3 | 4 | 3 | 0 | 4 | 3 | 2 | 3 | 3 | 3 | 1 | 3 | 2 | 2 |
| 366 | T | 5 | 2 | 2 | 2 | 5 | 2 | 3 | 6 | 1 | 6 | 6 | 4 | 1 | 3 | 3 | 4 | 0 | 5 | 3 | 5 |
| 367 | C | 5 | 0 | 3 | 2 | 4 | 4 | 5 | 4 | 5 | 4 | 4 | 4 | 3 | 4 | 6 | 4 | 4 | 4 | 4 | 4 |
| 368 | L | 3 | 2 | 2 | 2 | 4 | 2 | 4 | 5 | 3 | 0 | 2 | 4 | 2 | 3 | 4 | 4 | 3 | 2 | 2 | 3 |
| 369 | V | 2 | 1 | 1 | 1 | 5 | 1 | 1 | 3 | 2 | 3 | 3 | 2 | 1 | 2 | 3 | 1 | 1 | 0 | 2 | 2 |
| 370 | K | 4 | 3 | 4 | 4 | 5 | 3 | 3 | 5 | 0 | 5 | 5 | 3 | 3 | 4 | 5 | 5 | 4 | 6 | 5 | 5 |
| 371 | G | 5 | 5 | 2 | 4 | 5 | 0 | 4 | 6 | 5 | 5 | 5 | 4 | 3 | 4 | 6 | 5 | 5 | 6 | 6 | 5 |
| 372 | F | 2 | 2 | 2 | 1 | 0 | 1 | 4 | 5 | 4 | 5 | 5 | 2 | 2 | 3 | 5 | 2 | 4 | 5 | 3 | 5 |
| 373 | Y | 6 | 3 | 4 | 4 | 4 | 4 | 4 | 6 | 4 | 5 | 6 | 4 | 3 | 6 | 5 | 5 | 4 | 5 | 3 | 0 |
| 374 | P | 5 | 4 | 3 | 5 | 7 | 4 | 6 | 7 | 5 | 8 | 7 | 5 | 0 | 5 | 6 | 8 | 7 | 7 | 7 | 7 |
| 375 | S | 4 | 2 | 2 | 2 | 3 | 2 | 2 | 3 | 3 | 3 | 3 | 2 | 3 | 4 | 0 | 2 | 3 | 3 | 3 | 3 |
| 376 | D | 5 | 4 | 0 | 3 | 4 | 4 | 5 | 4 | 4 | 5 | 5 | 3 | 4 | 5 | 5 | 6 | 5 | 4 | 3 | 5 |
| 377 | I | 2 | 2 | 2 | 2 | 4 | 2 | 4 | 0 | 2 | 4 | 3 | 4 | 2 | 3 | 3 | 2 | 3 | 3 | 3 | 3 |
| 378 | A | 0 | 2 | 2 | 2 | 2 | 2 | 4 | 3 | 3 | 3 | 2 | 3 | 3 | 4 | 3 | 0 | 3 | 3 | 2 | 3 |
| 379 | V | 1 | 1 | 1 | 1 | 3 | 1 | 2 | 3 | 1 | 3 | 0 | 1 | 1 | 2 | 1 | 1 | 1 | 0 | 3 | 3 |
| 380 | E | 2 | 2 | 1 | 0 | 4 | 2 | 2 | 5 | 3 | 4 | 5 | 3 | 2 | 3 | 3 | 2 | 2 | 5 | 4 | 5 |
| 381 | W | 2 | 1 | 1 | 1 | 2 | 1 | 2 | 1 | 1 | 3 | 1 | 1 | 1 | 2 | 1 | 1 | 1 | 0 | 3 |
| 382 | E | 3 | 1 | 0 | 0 | 2 | 1 | 2 | 3 | 1 | 3 | 3 | 3 | 1 | 2 | 3 | 3 | 3 | 2 | 2 | 3 |
| 383 | S | 0 | 0 | 0 | 0 | 0 | 0 | 1 | 1 | 0 | 0 | 1 | 0 | 0 | 0 | 0 | 0 | 0 | 0 | 0 | 1 |
| 384 | N | 0 | 0 | 0 | 0 | 0 | 0 | 0 | 1 | 1 | 1 | 1 | 0 | 0 | 1 | 0 | 0 | 0 | 0 | 0 | 0 |
| 385 | G | 2 | 0 | 0 | 0 | 2 | 0 | 0 | 3 | 2 | 2 | 3 | 1 | 0 | 0 | 2 | 1 | 0 | 2 | 1 | 3 |
| 386 | Q | 1 | 1 | 0 | 1 | 1 | 1 | 1 | 1 | 1 | 1 | 1 | 0 | 1 | 0 | 1 | 1 | 1 | 1 | 1 | 1 |
| 387 | P | 1 | 0 | 1 | 1 | 2 | 0 | 2 | 2 | 0 | 2 | 3 | 1 | 0 | 1 | 1 | 1 | 2 | 2 | 0 | 2 |
| 388 | E | 1 | 1 | 0 | 0 | 3 | 1 | 2 | 3 | 1 | 3 | 4 | 2 | 1 | 2 | 1 | 1 | 1 | 3 | 3 | 3 |
| 389 | N | 1 | 1 | 1 | 1 | 2 | 1 | 1 | 2 | 2 | 2 | 2 | 0 | 0 | 1 | 2 | 1 | 2 | 2 | 2 | 2 |
| 390 | N | 1 | 1 | 0 | 0 | 2 | 2 | 1 | 2 | 2 | 2 | 2 | 0 | 0 | 2 | 2 | 2 | 2 | 2 | 2 | 2 |
| 391 | Y | 1 | 0 | 0 | 1 | 2 | 1 | 1 | 2 | 2 | 3 | 2 | 1 | 1 | 2 | 1 | 1 | 2 | 2 | 0 |
| 392 | K | 2 | 2 | 2 | 2 | 3 | 2 | 3 | 3 | 0 | 3 | 3 | 0 | 0 | 2 | 3 | 3 | 2 | 3 | 3 | 3 |
| 393 | T | 2 | 2 | 1 | 1 | 1 | 1 | 2 | 2 | 1 | 3 | 3 | 3 | 1 | 2 | 2 | 3 | 0 | 3 | 1 | 1 |
| 394 | T | 2 | 1 | 1 | 1 | 1 | 2 | 1 | 2 | 3 | 2 | 2 | 2 | 1 | 2 | 3 | 2 | 0 | 2 | 1 | 2 |
| 395 | P | 3 | 2 | 1 | 1 | 3 | 1 | 3 | 3 | 2 | 3 | 3 | 3 | 0 | 2 | 2 | 3 | 3 | 3 | 2 | 3 |
| 396 | P | 2 | 3 | 0 | 0 | 3 | 1 | 3 | 4 | 1 | 4 | 4 | 2 | 0 | 1 | 3 | 2 | 4 | 3 | 3 |
| 397 | V | 2 | 2 | 2 | 2 | 1 | 2 | 2 | 3 | 0 | 3 | 0 | 3 | 2 | 2 | 2 | 3 | 2 | 0 | 1 | 1 |
| 398 | L | 2 | 2 | 2 | 1 | 3 | 2 | 2 | 4 | 2 | 0 | 3 | 2 | 2 | 2 | 2 | 2 | 2 | 3 | 3 | 3 |
| 399 | D | 4 | 3 | 0 | 2 | 4 | 3 | 4 | 4 | 4 | 5 | 5 | 4 | 3 | 3 | 4 | 3 | 3 | 4 | 4 | 4 |
| 400 | S | 2 | 2 | 2 | 1 | 2 | 2 | 3 | 2 | 2 | 3 | 3 | 2 | 2 | 2 | 2 | 0 | 2 | 2 | 2 | 2 |

TABLE 68-continued

| EU No. | BH076 sequence | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 401 | D | 1 | 1 | 0 | 0 | 2 | 1 | 3 | 3 | 3 | 3 | 3 | 0 | 1 | 2 | 3 | 1 | 2 | 2 | 2 | 3 |
| 402 | G | 3 | 1 | 1 | 1 | 2 | 0 | 2 | 2 | 2 | 2 | 2 | 2 | 2 | 2 | 2 | 2 | 2 | 2 | 2 | 2 |
| 403 | S | 2 | 2 | 1 | 1 | 3 | 2 | 3 | 3 | 3 | 4 | 4 | 2 | 2 | 3 | 3 | 0 | 2 | 3 | 2 | 3 |
| 404 | F | 3 | 3 | 2 | 3 | 0 | 3 | 2 | 3 | 2 | 4 | 3 | 4 | 3 | 3 | 3 | 3 | 3 | 3 | 3 | 3 |
| 405 | F | 3 | 3 | 1 | 2 | 0 | 3 | 3 | 4 | 3 | 5 | 4 | 3 | 3 | 3 | 3 | 3 | 3 | 4 | 3 | 4 |
| 406 | L | 4 | 2 | 3 | 3 | 4 | 2 | 4 | 4 | 4 | 0 | 4 | 2 | 1 | 3 | 4 | 4 | 3 | 4 | 5 | 6 |
| 407 | Y | 5 | 4 | 2 | 3 | 7 | 4 | 4 | 5 | 6 | 5 | 5 | 6 | 4 | 6 | 6 | 5 | 6 | 6 | 6 | 0 |
| 408 | S | 6 | 4 | 3 | 3 | 6 | 5 | 4 | 5 | 5 | 6 | 6 | 6 | 3 | 5 | 5 | 0 | 4 | 5 | 6 | 5 |
| 409 | K | 5 | 5 | 4 | 5 | 6 | 4 | 5 | 7 | 0 | 7 | 7 | 5 | 4 | 5 | 0 | 5 | 4 | 7 | 6 | 6 |
| 410 | L | 4 | 3 | 4 | 4 | 6 | 3 | 4 | 5 | 6 | 0 | 4 | 3 | 3 | 4 | 6 | 3 | 3 | 4 | 7 | 5 |
| 411 | T | 5 | 5 | 5 | 4 | 8 | 4 | 6 | 9 | 4 | 8 | 8 | 6 | 6 | 6 | 8 | 6 | 0 | 8 | 7 | 8 |
| 412 | V | 5 | 4 | 2 | 4 | 6 | 4 | 5 | 5 | 4 | 6 | 6 | 4 | 4 | 4 | 5 | 4 | 4 | 0 | 4 | 5 |
| 413 | D | 7 | 7 | 0 | 3 | 8 | 6 | 7 | 8 | 8 | 7 | 8 | 7 | 6 | 8 | 9 | 6 | 7 | 7 | 7 | 8 |
| 414 | K | 3 | 3 | 3 | 3 | 5 | 3 | 4 | 4 | 0 | 5 | 5 | 3 | 2 | 3 | 3 | 3 | 4 | 4 | 4 | 5 |
| 415 | S | 3 | 2 | 1 | 1 | 4 | 1 | 2 | 4 | 3 | 3 | 3 | 2 | 2 | 2 | 4 | 0 | 2 | 2 | 3 | 3 |
| 416 | R | 2 | 1 | 1 | 1 | 3 | 1 | 1 | 3 | 1 | 3 | 3 | 2 | 2 | 2 | 0 | 1 | 1 | 3 | 2 | 3 |
| 417 | W | 2 | 2 | 2 | 1 | 3 | 0 | 2 | 3 | 2 | 3 | 3 | 4 | 3 | 1 | 3 | 4 | 2 | 3 | 0 | 3 |
| 418 | Q | 4 | 3 | 2 | 2 | 5 | 2 | 6 | 6 | 6 | 5 | 6 | 3 | 1 | 0 | 6 | 4 | 3 | 4 | 5 | 7 |
| 419 | Q | 1 | 2 | 1 | 0 | 2 | 1 | 1 | 2 | 4 | 4 | 3 | 2 | 1 | 0 | 5 | 2 | 1 | 2 | 3 | 3 |
| 420 | G | 2 | 2 | 1 | 2 | 3 | 0 | 1 | 3 | 3 | 3 | 3 | 4 | 0 | 3 | 3 | 4 | 3 | 3 | 4 | 3 |
| 421 | N | 1 | 3 | 1 | 1 | 4 | 1 | 3 | 5 | 4 | 4 | 5 | 0 | 2 | 2 | 7 | 3 | 3 | 5 | 4 | 4 |
| 422 | V | 1 | 0 | 1 | 0 | 4 | 1 | 2 | 0 | 2 | 4 | 4 | 2 | 1 | 3 | 4 | 1 | 1 | 0 | 4 | 4 |
| 423 | F | 3 | 1 | 2 | 2 | 0 | 2 | 5 | 2 | 3 | 4 | 2 | 3 | 1 | 3 | 2 | 2 | 3 | 3 | 5 | 5 |
| 424 | S | 4 | 3 | 0 | 2 | 6 | 4 | 4 | 6 | 4 | 7 | 6 | 4 | 2 | 5 | 5 | 0 | 4 | 7 | 6 | 6 |
| 425 | C | 6 | 0 | 3 | 3 | 6 | 5 | 6 | 6 | 6 | 6 | 6 | 6 | 5 | 5 | 6 | 7 | 6 | 7 | 6 | 6 |
| 426 | S | 4 | 3 | 3 | 3 | 5 | 3 | 4 | 5 | 4 | 6 | 6 | 5 | 4 | 5 | 5 | 0 | 4 | 4 | 5 | 5 |
| 427 | V | 3 | 3 | 1 | 1 | 5 | 2 | 3 | 5 | 3 | 5 | 5 | 3 | 3 | 3 | 4 | 3 | 3 | 0 | 4 | 4 |
| 428 | M | 2 | 2 | 1 | 1 | 4 | 2 | 3 | 6 | 1 | 5 | 0 | 3 | 2 | 3 | 2 | 3 | 3 | 6 | 3 | 5 |
| 429 | H | 5 | 5 | 1 | 3 | 7 | 3 | 0 | 7 | 4 | 8 | 7 | 5 | 5 | 4 | 4 | 4 | 4 | 8 | 7 | 7 |
| 430 | E | 7 | 5 | 5 | 0 | 9 | 5 | 7 | 9 | 7 | 9 | 9 | 6 | 7 | 5 | 8 | 8 | 8 | 9 | 7 | 9 |
| 431 | A | 0 | 4 | 2 | 2 | 6 | 4 | 5 | 6 | 4 | 6 | 6 | 4 | 3 | 2 | 5 | 4 | 6 | 6 | 6 | 6 |
| 432 | L | 1 | 2 | 1 | 0 | 3 | 1 | 2 | 3 | 1 | 0 | 4 | 3 | 2 | 1 | 1 | 3 | 2 | 5 | 3 | 3 |
| 433 | H | 3 | 1 | 0 | 1 | 4 | 2 | 0 | 4 | 3 | 5 | 5 | 3 | 2 | 2 | 3 | 3 | 3 | 4 | 4 | 4 |
| 434 | N | 2 | 2 | 1 | 1 | 4 | 2 | 2 | 4 | 3 | 5 | 5 | 0 | 2 | 3 | 3 | 2 | 4 | 3 | 4 | 4 |
| 435 | H | 2 | 3 | 0 | 0 | 3 | 2 | 0 | 4 | 3 | 4 | 4 | 2 | 0 | 3 | 1 | 2 | 2 | 4 | 3 | 4 |
| 436 | Y | −1 | 1 | 1 | 0 | 2 | −1 | 2 | 3 | 2 | 3 | 3 | 2 | 0 | 1 | 4 | 1 | 1 | 2 | 1 | 0 |
| 437 | T | 0 | 1 | 0 | 0 | 2 | 0 | 2 | 3 | 3 | 2 | 1 | 0 | 0 | 0 | 4 | 1 | 0 | 2 | 3 | 2 |
| 438 | Q | 1 | 1 | 0 | 1 | 2 | 1 | 2 | 2 | 0 | 2 | 2 | 0 | 3 | 0 | 1 | 1 | 1 | 3 | 2 | 2 |
| 439 | E | 2 | 2 | 0 | 0 | 2 | 1 | 2 | 2 | −2 | 2 | 2 | 2 | −1 | 2 | 2 | 2 | 2 | 2 | 2 | 2 |
| 440 | S | −2 | 0 | 0 | −1 | −1 | −2 | −1 | 1 | −1 | 0 | 0 | 0 | 0 | −1 | 0 | 0 | 0 | −1 | −2 | −1 |
| 441 | L | 2 | 1 | 1 | 1 | −1 | 1 | 1 | 0 | 1 | 0 | 1 | 1 | 0 | 2 | 1 | 1 | 2 | 1 | −1 | 0 |
| 442 | S | 0 | 0 | −1 | −1 | 2 | −1 | 0 | 2 | −1 | 1 | 1 | −1 | 0 | 1 | 0 | 0 | −1 | 0 | −1 | −1 |
| 443 | L | 0 | 0 | 0 | 0 | 0 | −1 | 0 | 0 | −1 | 0 | 0 | 0 | 0 | 0 | −1 | 0 | 0 | 0 | −1 | 0 |
| 444 | S | 0 | −1 | 0 | 0 | 0 | 0 | 0 | 0 | −1 | 0 | 0 | 0 | 0 | 0 | 0 | 0 | 0 | 0 | 0 | 0 |
| 445 | P | 0 | 0 | 0 | 0 | 0 | 0 | 1 | 1 | 1 | 0 | 0 | 1 | 0 | 1 | 1 | 0 | 0 | 0 | 1 | 0 |

By the above-described methods and a combination thereof, variants of H240-AK072 and H240-BH076 described below were designed (Tables 69 and 70) regarding sites of residue substitution to alter the isoelectric point.

TABLE 69

| VARIANT NAME | TEMPLATE | MUTATED RESIDUE IN VARIANT (DIFFERENCE FROM TEMPLATE SEQUENCE) | | | | | | | | |
|---|---|---|---|---|---|---|---|---|---|---|
| H240-AK072 | H240-G1d | L234Y | L235Y | G236W | H268D | D270E | S298A | D356K | L358M | H435R |
| H240-FA001 | H240-AK072 | A231K | — | — | — | — | — | — | — | — |
| H240-FA002 | H240-AK072 | L242K | — | — | — | — | — | — | — | — |
| H240-FA003 | H240-AK072 | E233V | — | — | — | — | — | — | — | — |
| H240-FA004 | H240-AK072 | A231K | E233V | L242K | — | — | — | — | — | — |
| H240-FA005 | H240-AK072 | A231K | E233V | — | — | — | — | — | — | — |
| H240-FA006 | H240-AK072 | A231K | L242K | — | — | — | — | — | — | — |
| H240-FA007 | H240-AK072 | E233V | L242K | — | — | — | — | — | — | — |
| H240-FA008 | H240-AK072 | A231K | E233V | S239M | — | — | — | — | — | — |
| H240-FA009 | H240-AK072 | Q196K | — | — | — | — | — | — | — | — |
| H240-FA010 | H240-AK072 | Q196K | I199T | — | — | — | — | — | — | — |
| H240-FA011 | H240-AK072 | Q196K | V263K | — | — | — | — | — | — | — |
| H240-FA012 | H240-AK072 | Q196K | E272K | — | — | — | — | — | — | — |
| H240-FA013 | H240-AK072 | Q196K | G316K | — | — | — | — | — | — | — |
| H240-FA014 | H240-AK072 | Q196K | L358K | — | — | — | — | — | — | — |
| H240-FA015 | H240-AK072 | Q196K | S364K | — | — | — | — | — | — | — |
| H240-FA016 | H240-AK072 | Q196K | S383K | — | — | — | — | — | — | — |
| H240-FA017 | H240-AK072 | Q196K | P387K | — | — | — | — | — | — | — |
| H240-FA018 | H240-AK072 | Q196K | V397K | — | — | — | — | — | — | — |
| H240-FA019 | H240-AK072 | L358K | V397K | — | — | — | — | — | — | — |
| H240-FA020 | H240-AK072 | Q196K | I199T | L358K | — | — | — | — | — | — |

TABLE 69-continued

| VARIANT NAME | TEMPLATE | MUTATED RESIDUE IN VARIANT (DIFFERENCE FROM TEMPLATE SEQUENCE) | | | | | | | | |
|---|---|---|---|---|---|---|---|---|---|---|
| H240-FA021 | H240-AK072 | Q196K | I199T | L358K | V397K | — | — | — | — | — |
| H240-FA022 | H240-AK072 | Q196K | I199T | L358K | S383K | V397K | — | — | — | — |
| H240-FA023 | H240-AK072 | L242K | — | — | — | — | — | — | — | — |
| H240-FA024 | H240-AK072 | Q196K | I199T | E272K | L358K | — | — | — | — | — |
| H240-FA025 | H240-AK072 | Q196K | I199T | E272K | L358K | 5383K | — | — | — | — |
| H240-FA026 | H240-AK072 | Q196K | L234L | E272K | — | — | — | — | — | — |
| H240-FA027 | H240-AK072 | Q196K | L235L | E272K | — | — | — | — | — | — |
| H240-FA028 | H240-AK072 | Q196K | L234L | L235L | E272K | — | — | — | — | — |
| H240-FA029 | H240-AK072 | Q196K | P232K | E272K | — | — | — | — | — | — |
| H240-FA030 | H240-AK072 | Q196K | I199T | E272K | — | — | — | — | — | — |

TABLE 70

| VARIANT NAME | TEMPLATE | MUTATED RESIDUE IN VARIANT (DIFFERENCE FROM TEMPLATE SEQUENCE) | | | | | | | | |
|---|---|---|---|---|---|---|---|---|---|---|
| H240-BH076 | H240-G1d | D270E | K326D | A330M | K334E | D356E | L358M | K439E | — | — |
| H240-FB001 | H240-BH076 | K274Q | — | — | — | — | — | — | — | — |
| H240-FB010 | H240-BH076 | A231E | K274Q | — | — | — | — | — | — | — |
| H240-FB015 | H240-BH076 | G137E | K274Q | — | — | — | — | — | — | — |
| H240-FB016 | H240-BH076 | N203D | K274Q | — | — | — | — | — | — | — |
| H240-FB017 | H240-BH076 | G137E | N203D | K274Q | — | — | — | — | — | — |
| H240-FB018 | H240-BH076 | S131C | K133R | G137E | G138S | K274Q | — | — | — | — |
| H240-FB019 | H240-BH076 | S131C | K133R | G137E | G138S | N203D | K274Q | — | — | — |
| H240-FB020 | H240-BH076 | K147E | K274Q | — | — | — | — | — | — | — |
| H240-FB021 | H240-BH076 | K274Q | K288E | — | — | — | — | — | — | — |
| H240-FB022 | H240-BH076 | K274Q | K317E | — | — | — | — | — | — | — |
| H240-FB023 | H240-BH076 | K274Q | K320E | — | — | — | — | — | — | — |
| H240-FB024 | H240-BH076 | K274Q | G341E | — | — | — | — | — | — | — |
| H240-FB025 | H240-BH076 | K274Q | K360E | — | — | — | — | — | — | — |
| H240-FB028 | H240-BH076 | N203D | K274Q | K288E | — | — | — | — | — | — |
| H240-FB029 | H240-BH076 | N203D | K274Q | K317E | — | — | — | — | — | — |
| H240-FB030 | H240-BH076 | N203D | K274Q | K320E | — | — | — | — | — | — |
| H240-FB031 | H240-BH076 | N203D | K274Q | G341E | — | — | — | — | — | — |
| H240-FB032 | H240-BH076 | N203D | K274Q | K360E | — | — | — | — | — | — |
| H240-FB033 | H240-BH076 | G138E | K274Q | — | — | — | — | — | — | — |
| H240-FB034 | H240-BH076 | T139E | K274Q | — | — | — | — | — | — | — |
| H240-FB035 | H240-BH076 | Y198E | K274Q | — | — | — | — | — | — | — |
| H240-FB036 | H240-BH076 | K274Q | K320E | — | — | — | — | — | — | — |
| H240-FB037 | H240-BH076 | K274Q | S324E | — | — | — | — | — | — | — |
| H240-FB038 | H240-BH076 | K274Q | T335E | — | — | — | — | — | — | — |
| H240-FB039 | H240-BH076 | K274Q | S337D | — | — | — | — | — | — | — |
| H240-FB040 | H240-BH076 | K274Q | L358E | — | — | — | — | — | — | — |
| H240-FB041 | H240-BH076 | K274Q | Y278E | — | — | — | — | — | — | — |
| H240-FB042 | H240-BH076 | K274Q | K290E | — | — | — | — | — | — | — |
| H240-FB043 | H240-BH076 | K274Q | G316E | — | — | — | — | — | — | — |
| H240-FB044 | H240-BH076 | K274Q | K340E | — | — | — | — | — | — | — |
| H240-FB045 | H240-BH076 | K274Q | Q362E | — | — | — | — | — | — | — |
| H240-FB046 | H240-BH076 | K274Q | S383E | — | — | — | — | — | — | — |
| H240-FB047 | H240-BH076 | K274Q | N384E | — | — | — | — | — | — | — |
| H240-FB048 | H240-BH076 | K274Q | G385E | — | — | — | — | — | — | — |
| H240-FB049 | H240-BH076 | K274Q | Q386E | — | — | — | — | — | — | — |
| H240-FB050 | H240-BH076 | K274Q | N390E | — | — | — | — | — | — | — |
| H240-FB051 | H240-BH076 | K274Q | V422E | — | — | — | — | — | — | — |
| H240-FB052 | H240-BH076 | K214T | K274Q | — | — | — | — | — | — | — |
| H240-FB053 | H240-BH076 | K274E | — | — | — | — | — | — | — | — |
| H240-FB054 | H240-BH076 | G137E | N203D | K214T | K274Q | — | — | — | — | — |
| H240-FB055 | H240-BH076 | G137E | N203D | K214T | K274Q | K288E | — | — | — | — |
| H240-FB056 | H240-BH076 | G137E | K147E | N203D | K274Q | K288E | — | — | — | — |
| H240-FB057 | H240-BH076 | G137E | Y198E | N203D | K274Q | K288E | — | — | — | — |
| H240-FB058 | H240-BH076 | G137E | G138S | S192N | L193F | I199T | N203D | K274Q | — | — |
| H240-FB059 | H240-BH076 | G138E | K147E | K274Q | K288E | — | — | — | — | — |
| H240-FB060 | H240-BH076 | G138E | Y198E | K274Q | K288E | — | — | — | — | — |
| H240-FB061 | H240-BH076 | G138E | K214T | K274Q | K288E | — | — | — | — | — |
| H240-FB062 | H240-BH076 | G138E | K147E | Y198E | K274Q | — | — | — | — | — |
| H240-FB063 | H240-BH076 | G138E | K147E | K214T | K274Q | — | — | — | — | — |
| H240-FB064 | H240-BH076 | G137E | G138S | S192N | L193F | I199T | N203D | K214T | K274Q | — |
| H240-FB065 | H240-BH076 | G137E | G138S | S192N | L193F | I199T | N203D | K214T | K274Q | K288E |
| H240-FB066 | H240-BH076 | G137E | G138S | S192H | L193F | I199T | N203D | K214T | K274Q | N384E |
| H240-FB067 | H240-BH076 | G137E | G138S | S192N | L193F | I199T | N203D | K214T | K274Q | N390E |
| H240-FB068 | H240-BH076 | G137E | G138S | S192N | L193F | I199T | N203D | K214T | K274Q | V422E |
| H240-FB069 | H240-BH076 | G138E | K147E | K274Q | K288E | L358E | — | — | — | — |
| H240-FB070 | H240-BH076 | G138E | K147E | K274Q | K288E | L358E | N384E | — | — | — |
| H240-FB071 | H240-BH076 | G138E | K147E | K274Q | K288E | L358E | N390E | — | — | — |

TABLE 70-continued

| VARIANT NAME | TEMPLATE | MUTATED RESIDUE IN VARIANT (DIFFERENCE FROM TEMPLATE SEQUENCE) | | | | | | | | | | |
|---|---|---|---|---|---|---|---|---|---|---|---|---|
| H240-FB072 | H240-BH076 | G138E | K147E | K274Q | K288E | L358E | V422E | — | — | — | — | — |
| H240-FB073 | H240-BH076 | G138E | K147E | K274Q | K288E | L358E | N390E | V422E | — | — | — | — |
| H240-FB074 | H240-BH076 | G138E | K147E | K274Q | K288E | K340E | N384E | — | — | — | — | — |
| H240-FB075 | H240-BH076 | G137E | K147E | N203D | K274Q | K288E | K340E | N384E | — | — | — | — |
| H240-FB076 | H240-BH076 | G138E | K147E | K274Q | K288E | K338E | N384E | — | — | — | — | — |
| H240-FB077 | H240-BH076 | G137E | K147E | N203D | K274Q | K288E | K338E | N384E | — | — | — | — |
| H240-FB078 | H240-BH076 | G137E | G138S | K147E | S192N | L193F | I199T | N203D | K214T | K274Q | K288E | K338E | N384E |
| H240-FB079 | H240-BH076 | G137E | G138S | K147E | S192N | L193F | I199T | N203D | K214T | K274Q | K288E | K338E | N384E |
| H240-FB080 | H240-BH076 | G137E | K147E | N203D | K274Q | K288E | K338E | — | — | — | — | — |
| H240-FB081 | H240-BH076 | G138E | K147E | K274Q | K288E | K338E | — | — | — | — | — | — |
| H240-FB082 | H240-BH076 | G138E | K147E | K274Q | K288E | N384E | — | — | — | — | — | — |
| H240-FB083 | H240-BH076 | G137E | G138S | K147E | S192N | L193F | I199T | N203D | K214T | K274Q | K288E | — | — |
| H240-FB084 | H240-BH076 | G137E | G138S | K147E | S192N | L193F | I199T | N203D | K214T | K274Q | K288E | N384E | — |

[Construction of Expression Vector for H240-AK072/H240-BH076/L73-k0 Altered Antibodies]

First, in order to construct cDNAs for modified antibody H240-AK072/H240-BH076/L73-k0, synthetic oligo DNAs were designed using H240-AK072 or H240-BH076 as a template in such a way that they result in a mutation at each of selected amino acid residues. Then, animal cell expression vectors carrying genes of interest were constructed using each synthetic oligo DNA according to the method described in Reference Example 1.

[Expression and Purification of H240-AK072/H240-BH076/L73-k0 Altered Antibody]

To assess altered antibodies of H240-AK072/H240-BH076/L73-k0, modified antibodies were prepared according to the method described in Reference Example 1 by co-expressing in given combinations an L chain (L73-k0, SEQ ID NO: 106) and each H chain resulting from introduction of an alteration into H240-AK072 or H240-BH076 (the H chain resulting from introduction of an alteration into H240-AK072 is referred to as the A chain, while the H chain resulting from introduction of an alteration into H240-BH076 is referred to as the B chain) so that each of the resulting antibodies has A chain and B chain in any of the combination. SEQ ID NOs of representative A chains and B chains are shown in Table 71.

TABLE 71

| | NAME | SEQ ID NO |
|---|---|---|
| A CHAIN | H240-FA009 | 138 |
| | H240-FA012 | 139 |
| | H240-FA020 | 140 |
| | H240-FA021 | 141 |
| | H240-FA024 | 142 |
| | H240-FA030 | 143 |
| B CHAIN | H240-FB001 | 144 |
| | H240-FB015 | 145 |
| | H240-FB016 | 146 |
| | H240-FB017 | 147 |
| | H240-FB020 | 148 |
| | H240-FB021 | 149 |
| | H240-FB033 | 150 |
| | H240-FB047 | 151 |
| | H240-FB052 | 152 |
| | H240-FB056 | 153 |
| | H240-FB059 | 154 |
| | H240-FB064 | 155 |
| | H240-FB065 | 156 |
| | H240-FB082 | 157 |
| | H240-FB083 | 158 |
| | H240-FB084 | 159 |

[Example 28] Physicochemical Assessment of H240-AK072/H240-BH076/L73-k0 Variants

[Measurement of Retention Time Difference by Cation Exchange Chromatography]

Each antibody was assayed under the following condition.
Mobile phase A: 20 mM MES-NaOH, pH 6.0
Mobile phase B: 20 mM MES-NaOH, 200 mM NaCl, pH 6.0
Column: Bio Pro SP-F (YMC)
Flow rate: 0.5 ml/min
Gradient: 10% B (0-5 min), 10-60% B (5-55 min)
Detection: Abs. 280 nm FIG. 53 shows a representative chromatogram. The peak at an early position of elution corresponds to B chain-B chain homodimerized antibody, while the main peak corresponds to A chain-B chain heterodimerized antibody. A chain is introduced with a residue substitution (H435R) to reduce the binding to Protein A. The antibodies used in this experiment are removed in the purification step with rProtein A Sepharose™ Fast Flow (GE Healthcare) during the process of preparation by the method described in Reference Example 1. Thus, A chain-A chain homodimerized antibody is hardly detected under the condition described above. The present inventors calculated:
retention time difference ΔRT (min)=(retention time for heteromeric antibody peak)−(retention time for B-chain homomeric antibody peak), as an indicator to assess the separation of heterodimerized and homodimerized antibodies. Table 72 shows the results of assessment of various variants. The results demonstrate that the retention time difference between heteromeric antibody and homomeric antibody become larger depending on the introduction of designed residue substitutions and their combinations.

[Assessment of the Content of Aggregate by Gel Filtration Chromatography Method]

Purified antibodies were assessed for the content of aggregate by SEC analysis using ACQUITY UPLC H-Class system (Waters). 50 mM phosphate buffer, pH 7.0 containing 300 mM sodium chloride (Isekyu) was used as the mobile phase and BEH200 SEC (waters) was used as the analytical column. Measurements were carried out at a wavelength of 215 nm. The data was analyzed using Empower2 (Waters). The components eluted on the higher-molecular-weight side relative to the monomers were collectively regarded as the aggregate, and the content was calculated. Table 72 shows the assessment results for the various variants. The results suggest that the respective variants retain the stability concerning polymerization, since the content of aggregate was not drastically increased as compared to H240-AK072/H240-BH076/L73-k0 before alteration.

[Assessment of Altered Antibodies for the Midpoint Temperature of Thermal Denaturation (Tm) by Differential Scanning Fluorometry]

Thermal stability of antibodies was assessed by determining their midpoint temperature of thermal denaturation (Tm) by differential scanning fluorometry using Rotor-Gene Q (QIAGEN). This method has been reported to show an excellent correlation with Tm assessment using differential scanning calorimeter, which is a widely known method for assessing the thermal stability of antibodies (Journal of Pharmaceutical Science 2010, 4:1707-1720).

After 5000 times concentrated SYPRO orange (Molecular Probes) was diluted with PBS (Sigma), antibody solutions were mixed with it to prepare measurement samples. 20 μl each of the samples were placed in measurement tubes and the temperature was increased from 30° C. up to 99° C. The temperature was raised by 0.4° C. and left to stand for about 6 seconds, and the fluorescence intensity was determined at 470 nm (excitation wavelength)/555 nm (fluorescent wavelength).

From the data, the temperature at which fluorescence transition was observed was calculated as Tm using Rotor-Gene Q Series Software (QIAGEN). In the same manner as reported in Molecular Immunology 37 (2000) 697-706 and such, Tm of CH2 domain was defined as Tm1 corresponding to the first transition. Meanwhile, Tm values were close between CH3 and Fab of the tested antibodies, and it was judged difficult to compare them separately. Thus, Tm values used in this assessment are Tm1 values. Table 72 shows the assessment results for various variants. The results suggest that the respective variants retain the structural stability, because the Tm values were not drastically reduced as compared to H240-AK072/H240-BH076/L73-k0 before alteration.

TABLE 72

VARIOUS PHYSICAL PROPERTY DATA

| Name | ΔRT (min) | Tm (° C.) | AGGREGATE (%) |
|---|---|---|---|
| H240-AK072/H240-BH076/L73-k0 | 5.241 | 63.0 | 2.34 |
| H240-FA020/H240-FB059/L73-k0 | 17.283 | 62.6 | 1.78 |
| H240-FA020/H240-FB082/L73-k0 | 17.206 | 62.7 | 1.50 |
| H240-FA020/H240-FB083/L73-k0 | 19.658 | 62.5 | 3.38 |
| H240-FA020/H240-FB084/L73-k0 | 19.433 | 62.6 | 3.51 |
| H240-FA021/H240-FB059/L73-k0 | 17.886 | 62.0 | 1.28 |
| H240-FA021/H240-FB082/L73-k0 | 17.705 | 62.2 | 1.15 |
| H240-FA021/H240-FB083/L73-k0 | 20.203 | 62.0 | 2.49 |
| H240-FA021/H240-FB084/L73-k0 | 20.084 | 62.1 | 3.05 |
| H240-FA030/H240-FB059/L73-k0 | 24.494 | 59.9 | 0.62 |
| H240-FA030/H240-FB082/L73-k0 | 24.624 | 59.8 | 0.58 |
| H240-FA030/H240-FB083/L73-k0 | 26.710 | 59.9 | 1.96 |
| H240-FA030/H240-FB084/L73-k0 | 26.767 | 60.0 | 1.98 |
| H240-FA024/H240-FB059/L73-k0 | 27.505 | 59.9 | 0.67 |
| H240-FA024/H240-FB082/L73-k0 | 28.482 | 59.7 | 0.63 |
| H240-FA024/H240-FB083/L73-k0 | 31.255 | 59.7 | 1.87 |
| H240-FA024/H240-FB084/L73-k0 | 31.171 | 59.8 | 1.74 |

[Assessment of Separation in Ion-Exchange Chromatography Purification]

Each sample was assessed for the separation in an ion-exchange chromatography purification method using AKTA avant25 (GE healthcare). The mobile phase used was 20 mM MES buffer, pH 6.0, and 20 mM MES buffer, pH 6.0, containing 500 mM sodium chloride. The column used was Hi Trap SP HP 1 ml (GE healthcare). Purification was carried out by a gradient method using a mixture of two solutions. The purification data was collected at a wavelength of 280 nm. The result of elution was assessed using Unicorn6.1 (GE healthcare). FIG. 54 shows an assessment result for H240-FA021/H240-BF084/L73-k0 variant. The result demonstrates that, by introducing the residue substitutions newly identified in this experiment, homodimerized and heterodimerized antibodies can be separated and purified by purifications that use column medium used in large scale.

[Example 29] Immunological Assessment of H240-AK072/H240-BH076/L73-k0 Variants

[Assessment of the FcγR-Binding Activity by Surface Plasmon Resonance Method]

Antibodies of interest were analyzed for the interaction to FcgR according to the method described in Reference Example 8.

The assessment results for various variants are shown in Table 73. The results demonstrate that the FcγR-binding ability of H240-FA021/H240-BF084/L73-k0 variant, which was confirmed to be separated in FIG. 54, was comparable to that of H240-AK072/H240-BH076/L73-k0 before alteration.

TABLE 73

FcγR BINDING ACTIVITY DATA

| Name | KD (1a) | KD (2aR) | KD (2aH) | KD (2b) | KD (3aF) | KD (3aV) | EXPERIMENT # |
|---|---|---|---|---|---|---|---|
| H240-AK072/H240-BH076/L73-k0 | 1.10E−10 | 2.40E−07 | 7.20E−08 | 1.30E−06 | 2.90E−09 | 9.90E−10 | 1 |
| H240-FA024/H240-FB059/L73-k0 | 8.90E−11 | 2.90E−07 | 9.30E−08 | 1.60E−06 | 4.40E−09 | 1.30E−09 | 1 |
| H240-FA024/H240-FB064/L73-k0 | 9.50E−11 | 3.30E−07 | 1.10E−07 | 1.90E−06 | 4.70E−09 | 1.30E−09 | 1 |
| H240-FA024/H240-FB065/L73-k0 | 1.50E−10 | 3.00E−07 | 9.50E−08 | 1.70E−06 | 5.00E−09 | 1.40E−09 | 1 |
| H240-FA030/H240-FB059/L73-k0 | 1.20E−10 | 2.50E−07 | 8.50E−08 | 1.50E−06 | 4.80E−09 | 1.40E−09 | 1 |

TABLE 73-continued

FcγR BINDING ACTIVITY DATA

| Name | KD (1a) | KD (2aR) | KD (2aH) | KD (2b) | KD (3aF) | KD (3aV) | EXPERIMENT # |
|---|---|---|---|---|---|---|---|
| H240-FA030/H240-FB064/L73-k0 | 5.70E−11 | 2.90E−07 | 9.60E−08 | 1.80E−06 | 5.30E−09 | 1.50E−09 | 1 |
| H240-FA030/H240-FB065/L73-k0 | 1.00E−10 | 3.40E−07 | 9.90E−08 | 2.40E−06 | 4.60E−09 | 1.10E−09 | 1 |
| H240-FA012/H240-FB056/L73-k0 | 1.00E−10 | 2.80E−07 | 8.60E−08 | 1.40E−06 | 5.00E−09 | 1.30E−09 | 1 |
| H240-FA030/H240-FB059/L73-k0 | 8.20E−11 | 2.60E−07 | 8.50E−08 | 1.50E−06 | 3.90E−09 | 1.20E−09 | 1 |
| H240-FA030/H240-FB082/L73-k0 | 9.20E−11 | 3.00E−07 | 8.80E−08 | 1.90E−06 | 4.30E−09 | 1.30E−09 | 1 |
| H240-FA030/H240-FB083/L73-k0 | 8.10E−11 | 2.80E−07 | 8.20E−08 | 1.50E−06 | 3.90E−09 | 1.20E−09 | 1 |
| H240-FA030/H240-FB084/L73-k0 | 1.20E−10 | 2.70E−07 | 8.80E−08 | 2.50E−06 | 4.20E−09 | 1.30E−09 | 1 |
| H240-FA024/H240-FB082/L73-k0 | 1.30E−10 | 2.40E−07 | 8.00E−08 | 1.50E−06 | 4.60E−09 | 1.30E−09 | 1 |
| H240-FA024/H240-FB084/L73-k0 | 9.50E−11 | 2.50E−07 | 7.90E−08 | 1.50E−06 | 4.60E−09 | 1.20E−09 | 1 |
| H240-AK072/H240-BH076/L73-k0 | 1.20E−10 | 2.80E−07 | 6.90E−08 | 1.50E−06 | 3.70E−09 | 1.20E−09 | 2 |
| H240-FA009/H240-FB001/L73-k0 | 1.70E−10 | 2.50E−07 | 6.90E−08 | 1.30E−06 | 4.30E−09 | 1.10E−09 | 2 |
| H240-FA012/H240-FB001/L73-k0 | 7.60E−11 | 3.50E−07 | 1.10E−07 | 1.70E−06 | 6.30E−09 | 1.50E−09 | 2 |
| H240-FA030/H240-FB001/L73-k0 | 3.60E−11 | 4.40E−07 | 1.20E−07 | 3.30E−06 | 6.40E−09 | 1.70E−09 | 2 |
| H240-FA024/H240-FB001/L73-k0 | 1.80E−09 | 3.70E−07 | 1.10E−07 | 2.00E−06 | 6.70E−09 | 1.90E−09 | 2 |
| H240-FA009/H240-FB017/L73-k0 | 1.10E−10 | 2.30E−07 | 6.10E−08 | 1.40E−06 | 3.00E−09 | 8.40E−10 | 2 |
| H240-FA009/H240-FB015/L73-k0 | 9.30E−11 | 3.30E−07 | 8.40E−08 | 1.80E−06 | 4.20E−09 | 1.30E−09 | 2 |
| H240-FA009/H240-FB033/L73-k0 | 1.20E−10 | 3.10E−07 | 8.00E−08 | 1.60E−06 | 3.40E−09 | 1.00E−09 | 2 |
| H240-FA009/H240-FB020/L73-k0 | 1.20E−10 | 2.50E−07 | 6.40E−08 | 1.40E−06 | 3.90E−09 | 1.10E−09 | 2 |
| H240-FA009/H240-FB016/L73-k0 | 1.30E−10 | 2.50E−07 | 7.00E−08 | 1.40E−06 | 4.40E−09 | 1.00E−09 | 2 |
| H240-FA009/H240-FB052/L73-k0 | 5.10E−11 | 2.70E−07 | 7.20E−08 | 1.40E−06 | 4.30E−09 | 8.90E−10 | 2 |
| H240-FA009/H240-FB021/L73-k0 | 5.10E−11 | 2.80E−07 | 7.00E−08 | 2.20E−06 | 3.70E−09 | 7.80E−10 | 2 |
| H240-FA009/H240-FB047/L73-k0 | 5.00E−11 | 2.70E−07 | 7.40E−08 | 1.70E−06 | 4.40E−09 | 1.10E−09 | 2 |
| H240-AK072/H240-BH076/L73-k0 | 1.10E−10 | 2.40E−07 | 7.90E−08 | 1.40E−06 | 3.70E−09 | 1.20E−09 | 3 |
| H240-FA021/H240-FB059/L73-k0 | 6.90E−11 | 2.80E−07 | 9.20E−08 | 1.30E−06 | 4.40E−09 | 1.70E−09 | 3 |
| H240-FA021/H240-FB082/L73-k0 | 6.00E−11 | 2.30E−07 | 7.70E−08 | 1.60E−06 | 4.20E−09 | 1.50E−09 | 3 |
| H240-FA021/H240-FB083/L73-k0 | 7.80E−11 | 2.40E−07 | 6.90E−08 | 1.30E−06 | 3.90E−09 | 1.40E−09 | 3 |
| H240-FA021/H240-FB084/L73-k0 | 3.30E−11 | 2.30E−07 | 6.90E−08 | 1.30E−06 | 3.30E−09 | 1.30E−09 | 3 |
| H240-FA020/H240-FB059/L73-k0 | 3.80E−11 | 2.50E−07 | 7.70E−08 | 1.30E−06 | 3.50E−09 | 1.30E−09 | 3 |
| H240-FA020/H240-FB082/L73-k0 | 7.90E−11 | 2.70E−07 | 6.90E−08 | 1.20E−06 | 3.40E−09 | 1.10E−09 | 3 |
| H240-FA020/H240-FB083/L73-k0 | 1.20E−10 | 2.30E−07 | 6.50E−08 | 1.00E−06 | 3.40E−09 | 1.10E−09 | 3 |
| H240-FA020/H240-FB084/L73-k0 | 6.80E−11 | 2.20E−07 | 5.70E−08 | 1.40E−06 | 3.50E−09 | 1.00E−09 | 3 |

[Immunogenicity Risk Assessment Using in Silico Immunogenicity Predication Tool, Epibase]

The clinical usefulness and efficacy of antibody pharmaceuticals are limited by anti-drug antibodies (ADAs). ADAs affect the drug efficacy and kinetics of antibody pharmaceuticals and sometimes cause serious side effects. Many immunogenicity-influencing factors have been reported, and in particular it is believed to be important that T cell epitopes are contained in antigens. In silico tools available for predicting such T cell epitopes include Epibase (Lonza), iTope/TCED (Antitope), and EpiMatrix (EpiVax). It has been reported that sequences containing T-cell epitopes present in proteins of interest could be predicted by using the tools described above (Expert Opin Biol Ther. 2007 March; 7(3): 405-18).

Epibase Light (Lonza) is an in silico tool for calculating the binding capacity between 9-mer peptide and major DRB1 allele using FASTER algorism (Expert Opin Biol Ther. 2007 March; 7(3): 405-18). This tool enables identification of T-cell epitopes that strongly or moderately bind to MHC class II.

An in silico immunogenicity score can be determined for each modified antibody according to the following equation (Equation 4) in the system of Epibase Light (Lonza).

Immunogenicity score=Sum(each DRB1 allotype population frequency X number of critical epitopes)  [Equation 4]

The calculation reflects the abundance ratio of DRB1 allotypes. For this purpose, it is possible to use the following abundance ratio in Caucasian.
DRB1*1501(24.5%), DRB1*0301(23.7%), DRB1*0701 (23.3%), DRB1*0101(15.0%), DRB1*1101(11.6%), DRB1*1302(8.2%), DRB1*1401/1454(4.9%), DRB1*0901 (2.3%), DRB1*1502(0.5%), DRB1*1202(0.1%)

All epitopes contained in each modified antibody sequence that exhibit strong or moderate binding are identified by FASTER algorism, and then epitopes after excluding human germline sequences and junction sequences between variable region and constant region are used as critical epitopes in immunogenicity score calculation. When the score is smaller, it means that a sequence has lower immunogenicity risk. Table 74 shows the risk scores calculated for H240-AK072 and H240-BH076, and variants obtained therefrom. Thus, variants that result in improved separation and purification capacity for homodimer and heterodimer and whose immunogenicity risk is not greatly altered as compared to H240-AK072/H240-BH076/L73-k0 can be produced by selecting any combination of A chain and B chain.

TABLE 74

IMMUNOGENICITY RISK SCORE

| Name | RISK SCORE |
|---|---|
| H240-AK072 | 564.6 |
| H240-FA020 | 552.0 |
| H240-FA021 | 552.0 |
| H240-FA030 | 565.3 |
| H240-FA024 | 552.0 |
| H240-BH076 | 480.4 |
| H240-FB059 | 480.4 |
| H240-FB082 | 480.4 |
| H240-FB083 | 505.1 |
| H240-FB084 | 505.1 |

Example 30

Heterodimerized antibodies H240-Kn125/H240-Hl076/L73-k0 and H240-Kn120/H240-Hl068/L73-k0, which exhibit enhanced binding to activating FcgR, were identified in Examples 20 and 21. Among the alterations used in these heterodimerized antibodies, amino acids at positions 234 and 239 of H240-Kn125 and H240-Kn120 and amino acid at position 330 of H240-Hl076 were substituted with other amino acids to examine whether better heterodimerized antibodies can be obtained.

(30-1) Examination of the Amino Acid at Position 234

Y at position 234 (EU numbering), which is contained in H240-Kn125 and H240-Kn120, was substituted with native L, or V, D, Q, I, M, T, A, G, H, S, F, or E; and heterodimerized variants carrying H240-Hl076 and H240-Hl068 as the other chain were produced according to the method of Reference Example 1. For comparison with existing technology, an afucosylated antibody (H240-afucosyl_G1d/L73-k0) and H240-Kn032/H240-Hl032/L73-k0 which has S239D/A330L/I332E for both chains were produced. Furthermore, among the variants described in WO 2012/125850, variants corresponding to W187 (a variant which has S239D/A330M/K334V for one of the H chains and L234Y/K290Y/Y296W for the other H chain) and M81 (a variant which has S239D/K334V for one of the H chains and L234Y/Y296W/S298C for the other H chain), which show the highest affinity to FcγRIIIa and are considered to be the best variants, were produced. Specifically, H240-Kn204 resulting from the introduction of L234Y/K290Y/Y296W into H240-Kn033, H240-Hl211 resulting from the introduction of S239D/A330M/K334V into H240-Hl033, H240-Kn205 resulting from the introduction of L234Y/Y296W/S298C into H240-Kn033, and H240-Hl212 resulting from the introduction of S239D/K334V into H240-Hl033 were produced according to the method of Reference Example 1. H240-Kn204/H240-Hl211/L73-k0 and H240-Kn205/H240-Hl212/L73-k0 were prepared according to the method of Reference Example 1, by combining H240-Kn204 as one of the H chains and L73-k0 as the L chains with H240-Hl211 as the other H chain, and by combining H240-Kn205 as one of the H chains and L73-k0 as the L chains with H240-Hl212 as the other H chain, and then expressing them. The binding of the prepared variants to FcgRIa, FcgRIIaR, FcgRIIaH, FcgRIIb, FcgRIIIaF, and FcgRIIIaV was measured according to the method of Reference Example 8. Results of these measurements are summarized in Table 75.

TABLE 75

| Sample | template | AMINO ACID AT POSITION 234 | KD FOR FcgRIa (M) | KD FOR FcgRIIaR (M) | KD FOR FcgRIIaH (M) | KD FOR FcgRIIb (M) | KD FOR FcgRIIIaF (M) |
|---|---|---|---|---|---|---|---|
| H240-Kn033/H240-Hl033/L73-k0 | | | 9.5E−11 | 7.4E−07 | 5.2E−07 | 3.3E−06 | 2.9E−07 |
| H240-afucosyl_G1d/L73-k0 | | | 4.3E−10 | 4.9E−07 | 7.8E−07 | 2.6E−06 | 7.8E−08 |
| H240-Kn032/H240-Hl032/L73-k0 | | | 7.3E−11 | 3.4E−07 | 6.9E−07 | 6.2E−07 | 9.1E−09 |
| H240-Kn037/H240-Hl036/L73-k0 | | | 9.8E−11 | 2.9E−08 | 4.6E−08 | 3.8E−07 | 2.1E−08 |
| H240-Kn204/H240-Hl211/L73-k0 | | | 3.8E−11 | 6.4E−07 | 7.6E−07 | 1.3E−06 | 1.4E−08 |
| H240-Kn205/H240-Hl212/L73-k0 | | | 5.4E−11 | 6.1E−07 | 3.7E−07 | 1.6E−06 | 1.2E−08 |
| H240-Kn125/H240-Hl076/L73-k0 | | Y | 6.6E−11 | 4.2E−07 | 1.4E−07 | 3.9E−06 | 1.3E−09 |
| H240-Kn198/H240-Hl076/L73-k0 | H240-Kn125 | L | 8.3E−11 | 6.3E−07 | 1.4E−07 | 6.3E−06 | 1.5E−09 |
| H240-Kn200/H240-Hl076/L73-k0 | H240-Kn125 | S | 8.8E−11 | 7.9E−07 | 2.3E−07 | 6.2E−06 | 2.4E−09 |
| H240-Kn201/H240-Hl076/L73-k0 | H240-Kn125 | F | 5.8E−11 | 7.2E−07 | 1.4E−07 | 5.4E−06 | 1.8E−09 |
| H240-Kn202/H240-Hl076/L73-k0 | H240-Kn125 | E | 7.1E−11 | 6.4E−07 | 3.6E−07 | 4.1E−06 | 1.6E−09 |
| H240-Kn207/H240-Hl076/L73-k0 | H240-Kn125 | V | 8.5E−11 | 6.8E−07 | 1.7E−07 | 5.2E−06 | 1.9E−09 |
| H240-Kn208/H240-Hl076/L73-k0 | H240-Kn125 | D | 1.0E−10 | 5.0E−07 | 3.1E−07 | 3.2E−06 | 1.8E−09 |
| H240-Kn209/H240-Hl076/L73-k0 | H240-Kn125 | Q | 8.3E−11 | 1.2E−06 | 2.5E−07 | 7.5E−06 | 2.4E−09 |
| H240-Kn210/H240-Hl076/L73-k0 | H240-Kn125 | I | 7.9E−11 | 5.9E−07 | 1.5E−07 | 4.2E−06 | 1.8E−09 |
| H240-Kn211/H240-Hl076/L73-k0 | H240-Kn125 | M | 8.4E−11 | 5.5E−07 | 2.0E−07 | 4.2E−06 | 1.9E−09 |
| H240-Kn212/H240-Hl076/L73-k0 | H240-Kn125 | T | 9.4E−11 | 6.4E−07 | 2.3E−07 | 5.2E−06 | 2.1E−09 |
| H240-Kn213/H240-Hl076/L73-k0 | H240-Kn125 | A | 8.2E−11 | 8.2E−07 | 2.1E−07 | 6.1E−06 | 2.6E−09 |
| H240-Kn214/H240-Hl076/L73-k0 | H240-Kn125 | G | 6.1E−11 | 1.1E−06 | 3.3E−07 | 7.1E−06 | 3.4E−09 |
| H240-Kn215/H240-Hl076/L73-k0 | H240-Kn125 | H | 8.9E−11 | 1.0E−06 | 2.5E−07 | 6.1E−06 | 2.6E−09 |
| H240-Kn120/H240-Hl068/L73-k0 | | Y | 1.1E−10 | 2.3E−08 | 4.4E−08 | 1.5E−07 | 2.4E−09 |
| H240-Kn184/H240-Hl068/L73-k0 | H240-Kn120 | E | 1.6E−10 | 2.7E−08 | 7.0E−08 | 1.5E−07 | 2.2E−09 |
| H240-Kn189/H240-Hl068/L73-k0 | H240-Kn120 | S | 1.6E−10 | 2.3E−08 | 4.8E−08 | 1.5E−07 | 3.2E−09 |
| H240-Kn216/H240-Hl068/L73-k0 | H240-Kn120 | V | 1.7E−10 | 2.3E−08 | 3.2E−08 | 1.6E−07 | 3.4E−09 |
| H240-Kn217/H240-Hl068/L73-k0 | H240-Kn120 | D | 1.7E−10 | 2.8E−08 | 7.6E−08 | 1.2E−07 | 2.4E−09 |
| H240-Kn218/H240-Hl068/L73-k0 | H240-Kn120 | Q | 1.4E−10 | 3.7E−08 | 3.3E−08 | 2.2E−07 | 3.5E−09 |
| H240-Kn219/H240-Hl068/L73-k0 | H240-Kn120 | I | 1.5E−10 | 1.4E−08 | 2.0E−08 | 9.0E−08 | 2.7E−09 |
| H240-Kn220/H240-Hl068/L73-k0 | H240-Kn120 | M | 1.5E−10 | 2.5E−08 | 3.4E−08 | 1.6E−07 | 3.5E−09 |
| H240-Kn221/H240-Hl068/L73-k0 | H240-Kn120 | T | 1.8E−10 | 2.9E−08 | 4.4E−08 | 2.2E−07 | 2.7E−09 |
| H240-Kn222/H240-Hl068/L73-k0 | H240-Kn120 | A | 1.4E−10 | 2.8E−08 | 4.9E−08 | 1.9E−07 | 3.3E−09 |
| H240-Kn223/H240-Hl068/L73-k0 | H240-Kn120 | G | 1.3E−10 | 6.2E−08 | 9.4E−08 | 2.8E−07 | 4.2E−09 |
| H240-Kn224/H240-Hl068/L73-k0 | H240-Kn120 | H | 1.4E−10 | 5.4E−08 | 5.7E−08 | 3.6E−07 | 4.0E−09 |
| H240-Kn203/H240-Hl068/L73-k0 | H240-Kn120 | F | 4.3E−10 | 4.6E−08 | 4.9E−08 | 2.7E−07 | 3.4E−09 |
| H240-Kn199/H240-Hl068/L73-k0 | H240-Kn120 | L | 3.1E−10 | 2.0E−08 | 2.7E−08 | 1.3E−07 | 2.3E−09 |

| Sample | KD FOR FcgRIIIaV (M) | fold 2aR | fold 2aH | fold 2b | fold 3aF | fold 3aV |
|---|---|---|---|---|---|---|
| H240-Kn033/H240-Hl033/L73-k0 | 4.8E−08 | 1.0 | 1.0 | 1.0 | 1.0 | 1.0 |
| H240-afucosyl_G1d/L73-k0 | 6.9E−09 | 1.5 | 0.7 | 1.3 | 3.7 | 7.0 |
| H240-Kn032/H240-Hl032/L73-k0 | 3.1E−09 | 2.2 | 0.8 | 5.3 | 31.9 | 15.5 |
| H240-Kn037/H240-Hl036/L73-k0 | 6.8E−09 | 25.5 | 11.3 | 8.7 | 13.8 | 7.1 |
| H240-Kn204/H240-Hl211/L73-k0 | 7.4E−09 | 1.2 | 0.7 | 2.5 | 20.7 | 6.5 |
| H240-Kn205/H240-Hl212/L73-k0 | 4.2E−09 | 1.2 | 1.4 | 2.1 | 24.2 | 11.4 |
| H240-Kn125/H240-Hl076/L73-k0 | 2.6E−10 | 1.8 | 3.7 | 0.8 | 223.1 | 184.6 |
| H240-Kn198/H240-Hl076/L73-k0 | 5.4E−10 | 1.2 | 3.7 | 0.5 | 193.3 | 88.9 |

TABLE 75-continued

| | | | | | | |
|---|---|---|---|---|---|---|
| H240-Kn200/H240-Hl076/L73-k0 | 5.9E−10 | 0.9 | 2.3 | 0.5 | 120.8 | 81.4 |
| H240-Kn201/H240-Hl076/L73-k0 | 3.6E−10 | 1.0 | 3.7 | 0.6 | 161.1 | 133.3 |
| H240-Kn202/H240-Hl076/L73-k0 | 3.8E−10 | 1.2 | 1.4 | 0.8 | 181.3 | 126.3 |
| H240-Kn207/H240-Hl076/L73-k0 | 4.9E−10 | 1.1 | 3.1 | 0.6 | 152.6 | 98.0 |
| H240-Kn208/H240-Hl076/L73-k0 | 4.0E−10 | 1.5 | 1.7 | 1.0 | 161.1 | 120.0 |
| H240-Kn209/H240-Hl076/L73-k0 | 6.2E−10 | 0.6 | 2.1 | 0.4 | 120.8 | 77.4 |
| H240-Kn210/H240-Hl076/L73-k0 | 4.9E−10 | 1.3 | 3.5 | 0.8 | 161.1 | 98.0 |
| H240-Kn211/H240-Hl076/L73-k0 | 5.2E−10 | 1.3 | 2.6 | 0.8 | 152.6 | 92.3 |
| H240-Kn212/H240-Hl076/L73-k0 | 5.8E−10 | 1.2 | 2.3 | 0.6 | 138.1 | 82.8 |
| H240-Kn213/H240-Hl076/L73-k0 | 7.3E−10 | 0.9 | 2.5 | 0.5 | 111.5 | 65.8 |
| H240-Kn214/H240-Hl076/L73-k0 | 8.0E−10 | 0.7 | 1.6 | 0.5 | 85.3 | 60.0 |
| H240-Kn215/H240-Hl076/L73-k0 | 6.8E−10 | 0.7 | 2.1 | 0.5 | 111.5 | 70.6 |
| H240-Kn120/H240-Hl068/L73-k0 | 3.3E−10 | 32.2 | 11.8 | 22.0 | 120.8 | 145.5 |
| H240-Kn184/H240-Hl068/L73-k0 | 3.4E−10 | 27.4 | 7.4 | 22.0 | 131.8 | 141.2 |
| H240-Kn189/H240-Hl068/L73-k0 | 5.2E−10 | 32.2 | 10.8 | 22.0 | 90.6 | 92.3 |
| H240-Kn216/H240-Hl068/L73-k0 | 4.6E−10 | 32.2 | 16.3 | 20.6 | 85.3 | 104.3 |
| H240-Kn217/H240-Hl068/L73-k0 | 3.8E−10 | 26.4 | 6.8 | 27.5 | 120.8 | 126.3 |
| H240-Kn218/H240-Hl068/L73-k0 | 5.0E−10 | 20.0 | 15.8 | 15.0 | 82.9 | 96.0 |
| H240-Kn219/H240-Hl068/L73-k0 | 4.9E−10 | 52.9 | 26.0 | 36.7 | 107.4 | 98.0 |
| H240-Kn220/H240-Hl068/L73-k0 | 5.0E−10 | 29.6 | 15.3 | 20.6 | 82.9 | 96.0 |
| H240-Kn221/H240-Hl068/L73-k0 | 4.7E−10 | 25.5 | 11.8 | 15.0 | 107.4 | 102.1 |
| H240-Kn222/H240-Hl068/L73-k0 | 5.4E−10 | 26.4 | 10.6 | 17.4 | 87.9 | 88.9 |
| H240-Kn223/H240-Hl068/L73-k0 | 5.7E−10 | 11.9 | 5.5 | 11.8 | 69.0 | 84.2 |
| H240-Kn224/H240-Hl068/L73-k0 | 5.3E−10 | 13.7 | 9.1 | 9.2 | 72.5 | 90.6 |
| H240-Kn203/H240-Hl068/L73-k0 | 7.6E−10 | 16.1 | 10.6 | 12.2 | 85.3 | 63.2 |
| H240-Kn199/H240-Hl068/L73-k0 | 4.1E−10 | 37.0 | 19.3 | 25.4 | 126.1 | 117.1 |

In Table 75, "template" shows which of the H240-Kn125 and H240-Kn120 chains was used as a template for substituting the amino acid at position 234. "Amino acid at position 234" shows the residue of amino acid at position 234 (EU numbering) in H240-Kn125 or H240-Kn120 after amino acid substitution. "fold 2aR", "fold 2aH", "fold 2b", "fold 3aF", and "fold 3aV" show the relative binding activity of each variant to FcgRIIaR, FcgRIIaH, FcgRIIb, FcgRIIIaF, and FcgRIIIaV, respectively, when the binding activity of H240-Kn033/H240-Hl033/L73-k0, a variant produced by introducing only alterations that promote formation of a heterodimerized antibody into a native IgG1, is defined as 1. Specifically, they are values obtained by dividing the KD value of H240-Kn033/H240-Hl033/L73-k0 for each FcgR by the KD value of an individual variant for each FcgR.

Compared to H240-Kn033/H240-Hl033/L73-k0 produced by introducing only alterations that promote formation of a heterodimerized antibody into IgG1, the afucosylated antibody (H240-afucosyl_G1d/L73-k0) showed a four-fold enhancement of binding to FcgRIIIaF and a seven-fold enhancement of binding to FcgRIIIaV. H240-Kn032/H240-Hl032/L73-k0 carrying S239D/A330L/I332E in both chains showed a 32-fold enhancement of binding to FcgRIIIaF and a 16-fold enhancement of binding to FcgRIIIaV. The pre-existing heterodimerized antibody H240-Kn204/H240-Hl211 (a variant which has S239D/A330M/K334V in one of the H chains and L234Y/K290Y/Y296W in the other H chain) showed a 21-fold enhancement of binding to FcgRIIIaF and a seven-fold enhancement of binding to FcgRIIIaV, and H240-Kn205/H240-Hl212 (a variant which has S239D/K334V in one of the H chains and L234Y/Y296W/S298C in the other H chain) showed a 24-fold enhancement of binding to FcgRIIIaF and an 11-fold enhancement of binding to FcgRIIIaV. On the other hand, variants produced in this examination showed a 69-fold to 223-fold enhancement of binding to FcgRIIIaF and a 60-fold to 185-fold enhancement of binding to FcgRIIIaV, and all variants have higher FcgRIIIa-binding activities than those by pre-existing techniques. Among them, H240-Kn198/H240-Hl076/L73-k0 produced by substituting with native L for position 234 (EU numbering) in H240-Kn125 of H240-Kn125/H240-Hl076/L73-k0 showed the highest FcgRIIIaF binding, and the binding activity was 193-fold compared to that of H240-Kn033/H240-Hl033/L73-k0. H240-Kn184/H240-Hl068/L73-k0 produced by substituting with E for position 234 in H240-Kn120 of H240-Kn120/H240-Hl068/L73-k0 showed the highest FcgRIIIaV binding, and the binding activity was 141-fold compared to that of H240-Kn033/H240-Hl033/L73-k0. Variants having at least 100-fold greater binding activities to both FcgRIIIaF and FcgRIIIaV than those of H240-Kn033/H240-Hl033/L73-k0 are: H240-Kn201/H240-Hl076/L73-k0, H240-Kn202/H240-Hl076/L73-k0, and H240-Kn208/H240-Hl076/L73-k0, which were produced by substituting position 234 in H240-Kn125 of H240-Kn125/H240-Hl076/L73-k0 with F, E, and D, respectively; and H240-Kn184/H240-Hl068/L73-k0, H240-Kn217/H240-Hl068/L73-k0, H240-Kn221/H240-Hl068/L73-k0, and H240-Kn199/H240-Hl068/L73-k0, which were produced by substituting position 234 in H240-Kn120 of H240-Kn120/H240-Hl068/L73-k0 with E, D, T, and L, respectively. Among them, H240-Kn198/H240-Hl076/L73-k0, H240-Kn201/H240-Hl076/L73-k0, H240-Kn202/H240-Hl076/L73-k0, and H240-Kn208/H240-Hl076/L73-k0, which were produced by substituting position 234 in H240-Kn125 of H240-Kn125/H240-Hl076/L73-k0 with L, F, E, and D, respectively, all showed suppressed binding to inhibitory FcgRIIb to the same or a lower level than that of H240-Kn033/H240-Hl033/L73-k0, and they are excellent heterodimerized antibodies for inducing effector functions.

Variants showing higher binding activities to FcgRIIaR and FcgRIIaH than those of H240-Kn037/H240-Kn036/L73-k0 produced by pre-existing techniques for enhancing FcgRIIa binding were H240-Kn216/H240-Hl068/L73-k0, H240-Kn219/H240-Hl068/L73-k0, H240-Kn221/H240-Hl068/L73-k0, H240-Kn220/H240-Hl068/L73-k0, H240-Kn199/H240-Hl068/L73-k0, which were produced by substituting position 234 of H240-Kn120/H240-Hl068/L73-k0 with V, I, T, M, and L, respectively. Among them, H240-Kn219/H240-Hl068/L73-k0, H240-Kn221/H240-Hl068/L73-k0 produced by substitution with T, and H240-Kn199/H240-Hl068/L73-k0 produced by substitution with L have high FcgRIIIa-binding activities, and are excellent variants.

The above-mentioned results showed that all the variants examined here have higher FcgRIIIa binding than those obtained by pre-existing technology; and in some of these variants, their FcgRIIb-binding activity is not enhanced, or their FcgRIIa-binding activity is greater than that achieved by pre-existing technology. Thus, they were shown to be better heterodimerized antibodies than those obtained by pre-existing technology in terms of induction of antibody effector functions.

(30-2) Examination of the Amino Acid at Position 330

Next, the amino acid at position 330 was examined. The A330M alteration has been introduced into H240-Hl076 of H240-Kn125/H240-Hl076/L73-k0. Chains in which the amino acid at position 330 has been substituted with Ala (native form), Phe, Pro, Ile, Tyr, or His were produced according to the method of Reference Example 1, and they were expressed in combination with H240-Kn125. L73-k0 was used as the common antibody L chain. Binding of the produced variants to FcgRIa, FcgRIIaR, FcgRIIaH, FcgRIIb, FcgRIIIaF, and FcgRIIIaV was measured according to the method of Reference Example 8. These measurement results are summarized in Table 76.

All variants produced in this examination have higher FcgRIIIa-binding activity than those achieved by pre-existing technology of enhancing FcgRIIIa-binding; and among the variants examined, H240-Kn125/H240-Hl214/L73-k0 produced by substituting with Phe for position 330 showed the highest FcgRIIIaF binding, and H240-Kn125/H240-Hl217/L73-k0 produced by substituting with Y for position 330 showed the highest FcgRIIIaV binding. With respect to FcgRIIb binding, in comparison to variant H240-Kn033/H240-Hl033/L73-k0 produced by introducing into native IgG1 only alterations that promote formation of a heterodimerized antibody, of the variants examined this time, H240-Kn125/H240-Hl216/L73-k0 produced by substituting with Ile for position 330 showed the lowest binding of 0.4-fold, and H240-Kn125/H240-Hl218/L73-k0 produced by substituting with His for position 330 showed the highest binding of 1.1-fold, and both of these variants had the same or reduced FcgRIIb-binding activity as compared to that of H240-Kn033/H240-Hl033/L73-k0. FcgRIIaR-binding of H240-Kn125/H240-Hl076/L73-k0 was 1.8-fold compared to that of H240-Kn033/H240-Hl033/L73-k0; whereas of the variants examined this time, H240-Kn125/H240-Hl216/

TABLE 76

| Sample | AMINO ACID AT POSITION 330 | KD FOR FcgRIa (M) | KD FOR FcgRIIaR (M) | KD FOR FcgRIIaH (M) | KD FOR FcgRIIb (M) | KD FOR FcgRIIIaF (M) |
|---|---|---|---|---|---|---|
| H240-Kn033/H240-Hl033/L73-k0 | | 9.5E−11 | 7.4E−07 | 5.2E−07 | 3.3E−06 | 2.9E−07 |
| H240-afucosyl_G1d/L73-k0 | | 4.3E−10 | 4.9E−07 | 7.8E−07 | 2.6E−06 | 7.8E−08 |
| H240-Kn032/H240-Hl032/L73-k0 | | 7.3E−11 | 3.4E−07 | 6.9E−07 | 6.2E−07 | 9.1E−09 |
| H240-Kn037/H240-Hl036/L73-k0 | | 9.8E−11 | 2.9E−08 | 4.6E−08 | 3.8E−07 | 2.1E−08 |
| H240-Kn204/H240-Hl211/L73-k0 | | 3.8E−11 | 6.4E−07 | 7.6E−07 | 1.3E−06 | 1.4E−08 |
| H240-Kn205/H240-Hl212/L73-k0 | | 5.4E−11 | 6.1E−07 | 3.7E−07 | 1.6E−06 | 1.2E−08 |
| H240-Kn125/H240-Hl076/L73-k0 | M | 6.6E−11 | 4.2E−07 | 1.4E−07 | 3.9E−06 | 1.3E−09 |
| H240-Kn125/H240-Hl210/L73-k0 | A | 6.5E−11 | 6.5E−07 | 1.5E−07 | 6.9E−06 | 4.1E−09 |
| H240-Kn125/H240-Hl214/L73-k0 | F | 8.0E−11 | 4.5E−07 | 1.5E−07 | 4.4E−06 | 1.6E−09 |
| H240-Kn125/H240-Hl216/L73-k0 | I | 7.3E−11 | 7.7E−07 | 2.1E−07 | 8.3E−06 | 2.7E−09 |
| H240-Kn125/H240-Hl217/L73-k0 | Y | 7.6E−11 | 4.4E−07 | 1.3E−07 | 3.5E−06 | 2.4E−09 |
| H240-Kn125/H240-Hl218/L73-k0 | H | 9.2E−11 | 3.1E−07 | 1.1E−07 | 2.9E−06 | 2.6E−09 |

| Sample | KD FOR FcgRIIIaV (M) | fold 2aR | fold 2aH | fold 2b | fold 3aF | fold 3aV |
|---|---|---|---|---|---|---|
| H240-Kn033/H240-Hl033/L73-k0 | 4.8E−08 | 1.0 | 1.0 | 1.0 | 1.0 | 1.0 |
| H240-afucosyl_G1d/L73-k0 | 6.9E−09 | 1.5 | 0.7 | 1.3 | 3.7 | 7.0 |
| H240-Kn032/H240-Hl032/L73-k0 | 3.1E−09 | 2.2 | 0.8 | 5.3 | 31.9 | 15.5 |
| H240-Kn037/H240-Hl036/L73-k0 | 6.8E−09 | 25.5 | 11.3 | 8.7 | 13.8 | 7.1 |
| H240-Kn204/H240-Hl211/L73-k0 | 7.4E−09 | 1.2 | 0.7 | 2.5 | 20.7 | 6.5 |
| H240-Kn205/H240-Hl212/L73-k0 | 4.2E−09 | 1.2 | 1.4 | 2.1 | 24.2 | 11.4 |
| H240-Kn125/H240-Hl076/L73-k0 | 2.6E−10 | 1.8 | 3.7 | 0.8 | 223.1 | 184.6 |
| H240-Kn125/H240-Hl210/L73-k0 | 4.8E−10 | 1.1 | 3.5 | 0.5 | 70.7 | 100.0 |
| H240-Kn125/H240-Hl214/L73-k0 | 3.8E−10 | 1.6 | 3.5 | 0.8 | 181.3 | 126.3 |
| H240-Kn125/H240-Hl216/L73-k0 | 6.0E−10 | 1.0 | 2.5 | 0.4 | 107.4 | 80.0 |
| H240-Kn125/H240-Hl217/L73-k0 | 3.3E−10 | 1.7 | 4.0 | 0.9 | 120.8 | 145.5 |
| H240-Kn125/H240-Hl218/L73-k0 | 6.8E−10 | 2.4 | 4.7 | 1.1 | 111.5 | 70.6 |

In the Table, "Amino acid at position 330" indicates the residue of amino acid after substitution at position 330 in H240-Hl076. "fold 2aR", "fold 2aH", "fold 2b", "fold 3aF", and "fold 3aV" show the relative binding activity of each variant to FcgRIIaR, FcgRIIaH, FcgRIIb, FcgRIIIaF, and FcgRIIIaV, respectively, when the binding activity of H240-Kn033/H240-Hl033/L73-k0 is defined as 1. H240-Kn033/H240-Hl033/L73-k0 is a variant produced by introducing only alterations that promote formation of a heterodimerized antibody into a native IgG1. Specifically, they are values obtained by dividing the KD value of H240-Kn033/H240-Hl033/L73-k0 for each FcgR by the KD value of an individual variant for each FcgR.

L73-k0 produced by substituting with Ile for position 330 showed the lowest binding of 1.0-fold, and H240-Kn125/H240-Hl218/L73-k0 produced by substituting with His for position 330 showed the highest binding of 2.4-fold. Furthermore, regarding FcgRIIaH binding, H240-Kn125/H240-Hl216/L73-k0 produced by substituting with Ile for position 330 showed the lowest value at 2.5-fold, and H240-Kn125/H240-Hl218/L73-k0 produced by substituting with His for position 330 showed the highest value at 4.7-fold. The above-mentioned results showed that the variants produced by substituting with Ala, Phe, Ile, Tyr, or His for position 330 in H240-Hl076 of H240-Kn125/H240-Hl076/L73-k0 all have higher FcgRIIIa binding than those made by pre-existing technology, and their FcgRIIb-binding activities are not enhanced. In addition, several variants had higher FcgRIIa-binding activities than those made by pre-existing technology, and were shown to be better heterodimeric antibodies than those made by pre-existing technology in terms of induction of antibody effector functions.

(30-3) Examination of the Amino Acid at Position 239

An alteration of substituting Ser at position 239 with Met is introduced into both H240-Kn125 and H240-Kn120. Here, whether this Met can be substituted with Ile was examined. As shown in Table 44 of Example 17, substitution of position 239 with Ile enhances FcgRIIb binding more than substitution with Met, but this alteration has a stronger effect of enhancing binding to FcgRIIa and FcgRIIIa.

Specifically, position 239 was substituted with Ile in H240-Kn120 of H240-Kn120/H240-Hl068/L73-k0 and in H240-Kn125 of H240-Kn125/H240-Hl076/L73-k0 to produce H240-Kn229/H240-Hl068/L73-k0 and H240-Kn225/H240-Hl076/L73-k0, respectively, according to the method described in Reference Example 1. Binding of the produced variants to FcgRIa, FcgRIIaR, FcgRIIaH, FcgRIIb, FcgRIIIaF, and FcgRIIIaV was measured according to the method of Reference Example 8. These measurement results are summarized in Table 77.

The binding activities of H240-Kn225/H240-Hl076/L73-k0 produced by substituting with Ile for position 239 in H240-Kn125 of H240-Kn125/H240-Hl076/L73-k0 for FcgRIIIaF and FcgRIIIaV were enhanced by 264-fold and 253-fold, respectively, compared to those of H240-Kn033/H240-Hl033/L73-k0. Meanwhile, FcgRIIb binding was suppressed to 0.6-fold compared to that of H240-Kn033/H240-Hl033/L73-k0. The binding activities of H240-Kn229/H240-Hl068/L73-k0 produced by substituting with Ile for position 239 in H240-Kn120 of H240-Kn120/H240-Hl068/L73-k0 for FcgRIIIaF and FcgRIIIaV were enhanced by 138-fold and 62-fold, respectively, compared to those of H240-Kn033/H240-Hl033/L73-k0. The two types of variants produced in this examination were both better than those produced by pre-existing techniques for enhancing FcgRIIIa binding. In comparison to that of H240-Kn033/H240-Hl033/L73-k0, binding of H240-Kn229/H240-Hl068/L73-k0 to FcgRIIaR and FcgRIIaH was 46-fold and 13-fold, respectively, and it was greater than that of H240-Kn037/H240-Hl036/L73-k0 produced by pre-existing techniques for enhancing FcgRIIa binding.

(30-4) Examination of Combined Alterations

In the investigation till now, amino acids at positions 234 and 239 in H240-Kn125 and H240-Kn120, and amino acid at position 330 in H240-Hl076 have been examined Here, alterations in the variants obtained so far, which are considered to be highly effective for enhancing antibody effector functions, were combined to examine production of superior heterodimerized antibodies.

TABLE 77

| Sample | KD FOR FcgRIa (M) | KD FOR FcgRIIaR (M) | KD FOR FcgRIIaH (M) | KD FOR FcgRIIb (M) | KD FOR FcgRIIIaF (M) | KD FOR FcgRIIIaV (M) | fold 2aR | fold 2aH | fold 2b | fold 3aF | fold 3aV |
|---|---|---|---|---|---|---|---|---|---|---|---|
| H240-Kn033/H240-Hl033/L73-k0 | 9.5E−11 | 7.4E−07 | 5.2E−07 | 3.3E−06 | 2.9E−07 | 4.8E−08 | 1.0 | 1.0 | 1.0 | 1.0 | 1.0 |
| H240-afucosyl_G1d/L73-k0 | 4.3E−10 | 4.9E−07 | 7.8E−07 | 2.6E−06 | 7.8E−08 | 6.9E−09 | 1.5 | 0.7 | 1.3 | 3.7 | 7.0 |
| H240-Kn032/H240-Hl032/L73-k0 | 7.3E−11 | 3.4E−07 | 6.9E−07 | 6.2E−07 | 9.1E−09 | 3.1E−09 | 2.2 | 0.8 | 5.3 | 31.9 | 15.5 |
| H240-Kn037/H240-Hl036/L73-k0 | 9.8E−11 | 2.9E−08 | 4.6E−08 | 3.8E−07 | 2.1E−08 | 6.8E−09 | 25.5 | 11.3 | 8.7 | 13.8 | 7.1 |
| H240-Kn204/H240-Hl211/L73-k0 | 3.8E−11 | 6.4E−07 | 7.6E−07 | 1.3E−06 | 1.4E−08 | 7.4E−09 | 1.2 | 0.7 | 2.5 | 20.7 | 6.5 |
| H240-Kn205/H240-Hl212/L73-k0 | 5.4E−11 | 6.1E−07 | 3.7E−07 | 1.6E−06 | 1.2E−08 | 4.2E−09 | 1.2 | 1.4 | 2.1 | 24.2 | 11.4 |
| H240-Kn225/H240-Hl076/L73-k0 | 3.6E−11 | 4.9E−07 | 1.7E−07 | 5.2E−06 | 1.1E−09 | 1.9E−10 | 1.5 | 3.1 | 0.6 | 263.6 | 252.6 |
| H240-Kn229/H240-Hl068/L73-k0 | 1.3E−10 | 1.6E−08 | 3.9E−08 | 2.0E−07 | 2.1E−09 | 7.7E−10 | 46.3 | 13.3 | 16.5 | 138.1 | 62.3 |

In the Table, "fold 2aR", "fold 2aH", "fold 2b", "fold 3aF", and "fold 3aV" show the relative binding activity of each variant to FcgRIIaR, FcgRIIaH, FcgRIIb, FcgRIIIaF, and FcgRIIIaV, respectively, when the binding activity of H240-Kn033/H240-Hl033/L73-k0 is defined as 1. H240-Kn033/H240-Hl033/L73-k0 is a variant produced by introducing into a native IgG1 only alterations that promote formation of a heterodimerized antibody. Specifically, they are values obtained by dividing the KD value of H240-Kn033/H240-Hl033/L73-k0 for each FcgR by the KD value of an individual variant for each FcgR.

Specifically, antibody heavy chain genes in which F, E, D, S, or L was introduced at position 234 and I or M was introduced at position 239 in H240-Kn125 were produced. Furthermore, antibody heavy chains in which V, E, D, T, I, L, or F was introduced at position 234 and M or I was introduced at position 239 in H240-Kn120 were produced. For the other antibody H chain, an H chain produced by introducing A or F at position 330 in H240-Hl076, or alternatively, H240-Hl068, was used. L73-k0 was used as the common antibody L chain. Binding of the produced variants to FcgRIa, FcgRIIaR, FcgRIIaH, FcgRIIb, FcgRIIIaF, and FcgRIIIaV was measured according to the method of Reference Example 8. Results of these measurements are summarized in Table 78.

TABLE 78

| Sample | Kn template | AMINO ACID AT POSITION 234 | AMINO ACID AT POSITION 239 | HI template | AMINO ACID AT POSITION 330 | KD FOR FcgRIa (M) | KD FOR FcgRIIaR (M) | KD FOR FcgRIIaH (M) |
|---|---|---|---|---|---|---|---|---|
| H240-Kn033/H240-Hl033/L73-k0 | | | | | | 9.5E−11 | 7.4E−07 | 5.2E−07 |
| H240-afucosyl_G1d/L73-k0 | | | | | | 4.3E−10 | 4.9E−07 | 7.8E−07 |
| H240-Kn032/H240-Hl032/L73-k0 | | | | | | 7.3E−11 | 3.4E−07 | 6.9E−07 |
| H240-Kn037/H240-Hl036/L73-k0 | | | | | | 9.8E−11 | 2.9E−08 | 4.6E−08 |
| H240-Kn204/H240-Hl211/L73-k0 | | | | | | 3.8E−11 | 6.4E−07 | 7.6E−07 |
| H240-Kn205/H240-Hl212/L73-k0 | | | | | | 5.4E−11 | 6.1E−07 | 3.7E−07 |

TABLE 78-continued

| | Kn template | Amino acid at position 234 | Amino acid at position 239 | HI template | Amino acid at position 330 | KD for FcgRIaR (M) | KD for FcgRIIaH (M) | KD for FcgRIIb (M) |
|---|---|---|---|---|---|---|---|---|
| H240-Kn230/H240-HI068/L73-k0 | Kn120 | V | I | HI068 | | 1.8E-10 | 9.6E-09 | 2.2E-08 |
| H240-Kn233/H240-HI068/L73-k0 | Kn120 | E | I | HI068 | | 1.8E-10 | 2.1E-08 | 6.6E-08 |
| H240-Kn234/H240-HI068/L73-k0 | Kn120 | D | I | HI068 | | 1.9E-10 | 2.1E-08 | 6.5E-08 |
| H240-Kn236/H240-HI068/L73-k0 | Kn120 | T | I | HI068 | | 2.2E-10 | 2.1E-08 | 3.4E-08 |
| H240-Kn226/H240-HI210/L73-k0 | Kn125 | F | I | HI076 | A | 1.1E-10 | 3.1E-07 | 1.2E-07 |
| H240-Kn227/H240-HI210/L73-k0 | Kn125 | E | I | HI076 | A | 1.7E-10 | 2.6E-07 | 2.3E-07 |
| H240-Kn228/H240-HI210/L73-k0 | Kn125 | D | I | HI076 | A | 1.6E-10 | 2.0E-07 | 1.9E-07 |
| H240-Kn226/H240-HI214/L73-k0 | Kn125 | F | I | HI076 | F | 8.9E-11 | 3.6E-07 | 1.6E-07 |
| H240-Kn227/H240-HI214/L73-k0 | Kn125 | E | I | HI076 | F | 1.3E-10 | 3.7E-07 | 2.9E-07 |
| H240-Kn228/H240-HI214/L73-k0 | Kn125 | D | I | HI076 | F | 1.2E-10 | 3.2E-07 | 2.7E-07 |
| H240-Kn201/H240-HI214/L73-k0 | Kn125 | F | M | HI076 | F | 9.1E-11 | 5.6E-07 | 1.5E-07 |
| H240-Kn208/H240-HI214/L73-k0 | Kn125 | D | M | HI076 | F | 5.3E-11 | 7.2E-07 | 4.2E-07 |
| H240-Kn202/H240-HI214/L73-k0 | Kn125 | E | M | HI076 | F | 9.0E-11 | 8.3E-07 | 4.4E-07 |
| H240-Kn231/H240-HI068/L73-k0 | Kn120 | I | I | HI068 | | 1.8E-10 | 8.9E-09 | 1.6E-08 |
| H240-Kn232/H240-HI068/L73-k0 | Kn120 | L | I | HI068 | | 2.3E-10 | 1.7E-08 | 2.5E-08 |
| H240-Kn235/H240-HI068/L73-k0 | Kn120 | F | I | HI068 | | 1 5E-10 | 2.3E-08 | 3.7E-08 |
| H240-Kn203/H240-HI210/L73-k0 | Kn120 | F | M | HI076 | A | 1.6E-10 | 5.6E-08 | 9.3E-08 |
| H240-Kn202/H240-HI210/L73-k0 | Kn125 | E | M | HI076 | A | 1.7E-10 | 3.2E-07 | 2.3E-07 |
| H240-Kn201/H240-HI210/L73-k0 | Kn125 | F | M | HI076 | A | 6.9E-11 | 4.3E-07 | 1.1E-07 |
| H240-Kn200/H240-HI210/L73-k0 | Kn125 | S | M | HI076 | A | 1.8E-10 | 4.8E-07 | 1.7E-07 |
| H240-Kn198/H240-HI210/L73-k0 | Kn125 | L | M | HI076 | A | 4.7E-11 | 4.8E-07 | 1.2E-07 |
| H240-Kn198/H240-HI068/L73-k0 | Kn125 | L | M | HI068 | | 2.4E-10 | 2.4E-07 | 4.9E-08 |
| H240-Kn200/H240-HI068/L73-k0 | Kn125 | S | M | HI068 | | 5.0E-10 | 2.8E-07 | 6.9E-08 |
| H240-Kn201/H240-HI068/L73-k0 | Kn125 | F | M | HI068 | | 2.6E-10 | 3.6E-07 | 5.6E-08 |
| H240-Kn202/H240-HI068/L73-k0 | Kn125 | E | M | HI068 | | 4.0E-10 | 2.0E-07 | 1.2E-07 |

| Sample | KD FOR FcgRIIb (M) | KD FOR FcgRIIIaF (M) | KD FOR FcgRIIIaV (M) | fold 2aR | fold 2aH | fold 2b | fold 3aF | fold 3aV |
|---|---|---|---|---|---|---|---|---|
| H240-Kn033/H240-HI033/L73-k0 | 3.3E-06 | 2.9E-07 | 4.8E-08 | 1.0 | 1.0 | 1.0 | 1.0 | 1.0 |
| H240-afucosyl_G1d/L73-k0 | 2.6E-06 | 7.8E-08 | 6.9E-09 | 1.5 | 0.7 | 1.3 | 3.7 | 7.0 |
| H240-Kn032/H240-HI032/L73-k0 | 6.2E-07 | 9.1E-09 | 3.1E-09 | 2.2 | 0.8 | 5.3 | 31.9 | 15.5 |
| H240-Kn037/H240-HI036/L73-k0 | 3.8E-07 | 2.1E-08 | 6.8E-09 | 25.5 | 11.3 | 8.7 | 13.8 | 7.1 |
| H240-Kn204/H240-HI211/L73-k0 | 1.3E-06 | 1.4E-08 | 7.4E-09 | 1.2 | 0.7 | 2.5 | 20.7 | 6.5 |
| H240-Kn205/H240-HI212/L73-k0 | 1.6E-06 | 1.2E-08 | 4.2E-09 | 1.2 | 1.4 | 2.1 | 24.2 | 11.4 |
| H240-Kn230/H240-HI068/L73-k0 | 1.5E-07 | 2.6E-09 | 9.3E-10 | 77.1 | 23.6 | 22.0 | 111.5 | 51.6 |
| H240-Kn233/H240-HI068/L73-k0 | 2.1E-07 | 2.5E-09 | 7.5E-10 | 35.2 | 7.9 | 15.7 | 116.0 | 64.0 |
| H240-Kn234/H240-HI068/L73-k0 | 1.4E-07 | 2.3E-09 | 6.8E-10 | 35.2 | 8.0 | 23.6 | 126.1 | 70.6 |
| H240-Kn236/H240-HI068/L73-k0 | 1.9E-07 | 2.6E-09 | 9.0E-10 | 35.2 | 15.3 | 17.4 | 111.5 | 53.3 |
| H240-Kn226/H240-HI210/L73-k0 | 3.1E-06 | 3.7E-09 | 8.5E-10 | 2.4 | 4.3 | 1.1 | 78.4 | 56.5 |
| H240-Kn227/H240-HI210/L73-k0 | 2.5E-06 | 4.4E-09 | 9.1E-10 | 2.8 | 2.3 | 1.3 | 65.9 | 52.7 |
| H240-Kn228/H240-HI210/L73-k0 | 1.7E-06 | 4.4E-09 | 8.1E-10 | 3.7 | 2.7 | 1.9 | 65.9 | 59.3 |
| H240-Kn226/H240-HI214/L73-k0 | 3.4E-06 | 1.9E-09 | 7.7E-10 | 2.1 | 3.3 | 1.0 | 152.6 | 62.3 |
| H240-Kn227/H240-HI214/L73-k0 | 2.8E-06 | 1.8E-09 | 8.0E-10 | 2.0 | 1.8 | 1.2 | 161.1 | 60.0 |
| H240-Kn228/H240-HI214/L73-k0 | 2.3E-06 | 1.9E-09 | 7.7E-10 | 2.3 | 1.9 | 1.4 | 152.6 | 62.3 |
| H240-Kn201/H240-HI214/L73-k0 | 3.7E-06 | 3.9E-09 | 1.4E-09 | 1.3 | 3.5 | 0.9 | 74.4 | 34.3 |
| H240-Kn208/H240-HI214/L73-k0 | 4.5E-06 | 3.0E-09 | 9.0E-10 | 1.0 | 1.2 | 0.7 | 96.7 | 53.3 |
| H240-Kn202/H240-HI214/L73-k0 | 6.1E-06 | 2.6E-09 | 9.5E-10 | 0.9 | 1.2 | 0.5 | 111.5 | 50.5 |
| H240-Kn231/H240-HI068/L73-k0 | 1.2E-07 | 2.9E-09 | 7.3E-10 | 83.1 | 32.5 | 27.5 | 100.0 | 65.8 |
| H240-Kn232/H240-HI068/L73-k0 | 1.9E-07 | 3.0E-09 | 8.6E-10 | 43.5 | 20.8 | 17.4 | 96.7 | 55.8 |
| H240-Kn235/H240-HI068/L73-k0 | 2.2E-07 | 2.7E-09 | 8.7E-10 | 32.2 | 14.1 | 15.0 | 107.4 | 55.2 |
| H240-Kn203/H240-HI210/L73-k0 | 3.0E-07 | 3.0E-09 | 4.5E-10 | 13.2 | 5.6 | 11.0 | 96.7 | 106.7 |
| H240-Kn202/H240-HI210/L73-k0 | 2.2E-06 | 3.3E-09 | 5.3E-10 | 2.3 | 2.3 | 1.5 | 87.9 | 90.6 |
| H240-Kn201/H240-HI210/L73-k0 | 7.2E-06 | 3.2E-09 | 4.9E-10 | 1.7 | 4.7 | 0.5 | 90.6 | 98.0 |
| H240-Kn200/H240-HI210/L73-k0 | 2.6E-06 | 5.7E-09 | 1.2E-09 | 1.5 | 3.1 | 1.3 | 50.9 | 40.0 |
| H240-Kn198/H240-HI210/L73-k0 | 3.1E-06 | 4.9E-09 | 1.0E-09 | 1.5 | 4.3 | 1.1 | 59.2 | 48.0 |
| H240-Kn198/H240-HI068/L73-k0 | 1.6E-06 | 3.7E-09 | 8.5E-10 | 3.1 | 10.6 | 2.1 | 78.4 | 56.5 |
| H240-Kn200/H240-HI068/L73-k0 | 2.8E-06 | 4.6E-09 | 1.2E-09 | 2.6 | 7.5 | 1.2 | 63.0 | 40.0 |
| H240-Kn201/H240-HI068/L73-k0 | 3.9E-06 | 5.3E-09 | 1.2E-09 | 2.1 | 9.3 | 0.8 | 54.7 | 40.0 |
| H240-Kn202/H240-HI068/L73-k0 | 1.4E-06 | 2.5E-09 | 6.6E-10 | 3.7 | 4.3 | 2.4 | 116.0 | 72.7 |

In the Table, "Kn template" shows which of the H240-Kn120 and H240-Kn125 chains was used as the template for alteration, and "Hl template" shows which of the H240-Hl068 and H240-Hl076 chains was used as the template. "Amino acid at position 234" and "Amino acid at position 239" indicate the type of amino acids at positions 234 and 239 in the Kn chain, and "Amino acid at position 330" indicates the type of amino acid at position 330 in the HI chain after amino acid substitution. "fold 2aR", "fold 2aH", "fold 2b", "fold 3aF", and "fold 3aV" show the relative binding activity of each variant to FcgRIIaR, FcgRIIaH, FcgRIIb, FcgRIIIaF, and FcgRIIIaV, respectively, when the binding activity of H240-Kn033/H240-Hl033/L73-k0 is defined as 1. H240-Kn033/H240-Hl033/L73-k0 is a variant produced by introducing into a native IgG1 only alterations that promote formation of a heterodimerized antibody. Specifically, they are values obtained by dividing the KD value of H240-Kn033/H240-Hl033/L73-k0 for each FcgR by the KD value of an individual variant for each FcgR.

Compared to H240-Kn033/H240-Hl033/L73-k0 which is a variant produced by introducing into a native IgG1 only alterations that promote formation of a heterodimerized antibody, the variants produced in this examination had an enhancement of 51-fold to 161-fold FcgRIIIaF-binding activity and an enhancement of 34-fold to 107-fold FcgRIIIaV-binding activity, and all variants had higher binding activities than the variants obtained by pre-existing technology for enhancing FcgRIIIa binding. The variant that showed the most enhancement of FcgRIIIaF-binding activity was H240-Kn227/H240-Hl214/L73-k0 produced by substituting with E for position 234 and I for position 239 in H240-Kn125 and F for position 330 in H240-Hl076. The variant that showed the most enhancement of FcgRIIIaV-binding activity was H240-Kn203/H240-Hl210/L73-k0 produced by substituting with F for position 234 in H240-Kn120 and A for position 330 in H240-Hl076. Variants with enhanced binding activity to both FcgRIIIaF and FcgRIIIaV include H240-Kn226/H240-Hl214/L73-k0 (where position 234 is substituted with F and position 239 is substituted with I in H240-Kn125, and position 330 is substituted with F in H240-Hl076), H240-Kn227/H240-Hl214/L73-k0 (where position 234 is substituted with E and position 239 is substituted with I in H240-Kn125, and position 330 is substituted with F in H240-Hl076), and H240-Kn228/H240-Hl214/L73-k0 (where position 234 is substituted with D and position 239 is substituted with I in H240-Kn125, and position 330 is substituted with F in H240-Hl076). FcgRIIb binding was also maintained in these variants to the same degree as in H240-Kn033/H240-Hl033/L73-k0 (1.0-fold to 1.4-fold).

In comparison to the wild type H240-Kn033/H240-Hl033/L73-k0, there was a 0.9-fold to 83-fold enhancement of FcgRIIaR-binding activity and a 1.2-fold to 33-fold enhancement of FcgRIIaH-binding activity; and H240-Kn231/H240-Hl068/L73-k0 produced by substituting with I for positions 234 and 239 in H240-Kn120 showed the most enhancement of binding activities. Variants whose binding activities to both FcgRIIaR and FcgRIIaH were increased compared to those of H240-Kn037/H240-Kn036/L73-k0, which was produced by introducing pre-existing alterations that enhance FcgRIIa binding, were H240-Kn230/H240-Hl068/L73-k0 (where position 234 is substituted with V and position 239 is substituted with I in H240-Kn120), H240-Kn236/H240-Hl068/L73-k0 (where position 234 is substituted with T and position 239 is substituted with I in H240-Kn120), H240-Kn231/H240-Hl068/L73-k0 (where positions 234 and 239 are substituted with I in H240-Kn120), H240-Kn232/H240-Hl068/L73-k0 (where position 234 is substituted with L and position 239 is substituted with I in H240-Kn120), and H240-Kn235/H240-Hl068/L73-k0 (where position 234 is substituted with F and position 239 is substituted with I in H240-Kn120).

The results showed that all of the variants examined here have higher FcgRIIIa-binding activities than those obtained by pre-existing technology; and in some variants, the FcgRIIa-binding activities were also higher than those obtained by pre-existing technology. Thus, they were shown to be better heterodimerized antibodies than those obtained by pre-existing technology in terms of induction of antibody effector functions.

The SEQ ID NOs of the H chains of the examined variants are shown in Table 79.

TABLE 79

| SEQUENCE NAME | SEQ ID NO |
|---|---|
| H240-Kn204 | 160 |
| H240-Hl210 | 161 |
| H240-Hl211 | 162 |
| H240-Hl212 | 163 |
| H240-Hl214 | 164 |
| H240-Hl216 | 165 |
| H240-Hl217 | 166 |

TABLE 79-continued

| SEQUENCE NAME | SEQ ID NO |
|---|---|
| H240-Hl218 | 167 |
| H240-Kn184 | 168 |
| H240-Kn189 | 169 |
| H240-Kn198 | 170 |
| H240-Kn199 | 171 |
| H240-Kn200 | 172 |
| H240-Kn201 | 173 |
| H240-Kn202 | 174 |
| H240-Kn203 | 175 |
| H240-Kn205 | 176 |
| H240-Kn207 | 177 |
| H240-Kn208 | 178 |
| H240-Kn209 | 179 |
| H240-Kn210 | 180 |
| H240-Kn211 | 181 |
| H240-Kn212 | 182 |
| H240-Kn213 | 183 |
| H240-Kn214 | 184 |
| H240-Kn215 | 185 |
| H240-Kn216 | 186 |
| H240-Kn217 | 187 |
| H240-Kn218 | 188 |
| H240-Kn219 | 189 |
| H240-Kn220 | 190 |
| H240-Kn221 | 191 |
| H240-Kn222 | 192 |
| H240-Kn223 | 193 |
| H240-Kn224 | 194 |
| H240-Kn225 | 195 |
| H240-Kn226 | 196 |
| H240-Kn227 | 197 |
| H240-Kn228 | 198 |
| H240-Kn229 | 199 |
| H240-Kn230 | 200 |
| H240-Kn231 | 201 |
| H240-Kn232 | 202 |
| H240-Kn233 | 203 |
| H240-Kn234 | 204 |
| H240-Kn235 | 205 |

[Reference Example 1] Construction of Expression Vectors for Antibodies and Expression and Purification of Antibodies Amino acid substitutions were introduced by methods known to those skilled in the art using QuikChange Site-Directed Mutagenesis Kit (Stratagene), PCR, or In fusion Advantage PCR cloning kit (TAKARA), and expression vectors were constructed. The nucleotide sequence of the obtained expression vector was determined by methods known to those skilled in the art. The produced plasmids were introduced transiently into the HEK293H cell line derived from human embryonic kidney cancer cells (Invitrogen) or into FreeStyle293 cells (Invitrogen) for antibody expression. Antibodies were purified from the obtained culture supernatant by methods known to those skilled in the art using rProtein A Sepharose™ Fast Flow (GE Healthcare). For the concentration of the purified antibodies, their absorbance at 280 nm was measured using a spectrophotometer. From the obtained value, the extinction coefficient calculated by the PACE method was used to calculate the antibody concentration (Protein Science 1995; 4: 2411-2423).

[Reference Example 2] Preparation of FcγR and Assessment of Binding Activity to FcγR Extracellular domains of FcgRs were prepared by the following method. First, a gene of the extracellular domain of FcgR was synthesized by a method well known to those skilled in the art. At that time, the sequence of each FcgR was produced based on the information registered at NCBI. Specifically, FcgRI was produced based on the sequence of NCBI Accession # NM_000566.3, FcgRIIa was produced based on the sequence of NCBI Accession #NM_001136219.1, FcgRIIb was produced based on the sequence of NCBI Accession # NM_004001.3, FcgRIIIa was produced based on the sequence of NCBI Accession # NM_001127593.1, and FcgRIIIb was produced based on the sequence of NCBI Accession # NM_000570.3, and a His tag was attached to the C terminus. Furthermore, polymorphism is known for FcgRIIa, FcgRIIIa, and FcgRIIIb, and the polymorphic sites were produced by referring to J. Exp. Med., 1990, 172: 19-25 for FcgRIIa; J. Clin. Invest., 1997, 100 (5): 1059-1070 for FcgRIIIa; and J. Clin. Invest., 1989, 84, 1688-1691 for FcgRIIIb.

The obtained gene fragments were inserted into an animal cell expression vector, and expression vectors were produced. The produced expression vectors were introduced transiently into human embryonic kidney cancer cell line-derived FreeStyle293 cells (Invitrogen) to express the proteins of interest. Regarding FcgRIIb used for crystallographic analysis, the protein of interest was expressed in the presence of Kifunesine at a final concentration of 10 µg/mL, so that the sugar chain added to FcgRIIb will be the high-mannose type. Cells were cultured, and after collection of the obtained culture supernatant, this was passed through a 0.22 µm filter to obtain the culture supernatant. In principle, the obtained culture supernatants were purified in the following four steps. The steps carried out were, cation exchange column chromatography (SP Sepharose FF) in step 1, affinity column chromatography (HisTrap HP) for His tag in step 2, gel filtration column chromatography (Superdex200) in step 3, and aseptic chromatography in step 4. However, for FcgRI, anion exchange column chromatography using Q sepharose FF was performed as step 1. The purified proteins were subjected to absorbance measurements at 280 nm using a spectrophotometer; and from the obtained values, the concentrations of the purified proteins were calculated using the absorption coefficient calculated using methods such as PACE (Protein Science 1995; 4: 2411-2423).

Analysis of interaction between objective antibody and the FcγR was carried out using Biacore T100 (GE Healthcare). HBS-EP+ (GE Healthcare) was used as the running buffer, and the measurement temperature was set to 25° C. Chips produced by immobilizing the antigen peptide by the amine coupling method to a Series S Sencor Chip CM5 (GE Healthcare), or alternatively, chips produced by allowing preliminarily biotinylated antigen peptides to interact with and immobilize onto a Series S Sensor Chip SA (certified) (GE Healthcare) were used. Antibodies of interest were captured onto an antigen peptide-immobilized chip, and allowed to interact to each FcγR diluted with running buffer. To regenerate and repeatedly use the chip, the antibodies captured on the chip were washed off by reacting 10 mM glycine-HCl, pH 1.5.

The FcγR-binding activity of each antibody was assessed primarily using as an indicator the FcγR-binding activity and dissociation constant for FcγR.

The FcγR-binding activity refers to the relative binding activity to FcγR. Regarding the relative FcγR-binding activity, in each measurement the binding activity of a control sample was taken as 100(%) to calculate the binding activities of other antibodies. The binding activity described above was defined as a value obtained by dividing the level of change in the sensorgram before and after interaction of FcγR to the captured antibody by the quantity of each captured antibody. The reason is that the binding activity of FcγR depends on the quantity of the captured antibody.

The dissociation constant of each antibody for FcγR was calculated by performing kinetic analysis of the result of Biacore measurement. Specifically, to calculate association rate constant ka (L/mol/s) and dissociation rate constant kd (1/s), sensorgrams obtained by measurement were processed for global fitting by Biacore Evaluation Software using 1:1 Langmuir binding model and dissociation constant KD (mol/1) was calculated from the resulting values.

[Reference Example 3] Production of Expression Vectors for Heterodimerized Antibody Genes and Expression of Each Antibody As the antibody H chain variable region, those described below were used:
Q153 (the H chain variable region of anti-human F.IX antibody; SEQ ID NO: 61);
Q407 (the H chain variable region of anti-human F.IX antibody; SEQ ID NO: 62);
J142 (the H chain variable region of anti-human F.X antibody; SEQ ID NO: 63);
J300 (the H chain variable region of anti-human F.X antibody; SEQ ID NO: 64); and
MRA-VH (the H chain variable region of an anti-human interleukin-6 receptor antibody; SEQ ID NO: 65).

As the antibody L chain, those described below were used:
L180-k (the common L chain of anti-human F.IX antibody/anti-human F.X antibody; SEQ ID NO: 66);
L210-k (the common L chain of anti-human F.IX antibody/anti-human F.X antibody; SEQ ID NO: 67); and
MRA-k (the L chain of an anti-human interleukin-6 receptor antibody; SEQ ID NO: 68).

As the antibody H chain constant region, those described below were used:
G4d (SEQ ID NO: 69), which was constructed from IgG4 by introducing a substitution mutation from Ser to Pro at position 228 (EU numbering) and deleting the C-terminal Gly and Lys;
z72 (SEQ ID NO: 70), which was constructed from G4d by introducing a substitution mutation from His to Arg at position 435 (EU numbering), a substitution mutation from Tyr to Phe at position 436 (EU numbering), and a substitution mutation from Leu to Pro at position 445 (EU numbering);
z7 (SEQ ID NO: 71), which was constructed from G4d by introducing a substitution mutation from Glu to Lys at position 356 (EU numbering);
z73 (SEQ ID NO: 72), which was constructed from z72 by introducing a substitution mutation from Lys to Glu at position 439 (EU numbering);
z106 (SEQ ID NO: 73), which was constructed from z7 by introducing a substitution mutation from Lys to Gln at position 196 (EU numbering), a substitution mutation from Phe to Tyr at position 296 (EU numbering), and a substitution mutation from Arg to Lys at position 409 (EU numbering);
z107 (SEQ ID NO: 74), which was constructed from z73 by introducing a substitution mutation from Lys to Gln at position 196 (EU numbering), a substitution mutation from Phe to Tyr at position 296 (EU numbering), a substitution mutation from Arg to Lys at position 409 (EU numbering), and a substitution mutation from Phe to Tyr at position 436 (EU numbering); and G1d (SEQ ID NO: 75), which was constructed by deleting the C-terminal Gly and Lys from IgG1. The substitution mutation from Glu to Lys at position 356 (EU numbering) and the substitution mutation from Lys to Glu at position 439 (EU numbering) were introduced for efficient formation of heteromeric molecules from the respective H chains in producing heteromeric antibodies ((WO 2006/106905) PROCESS FOR PRODUCTION OF POLYPEPTIDE BY REGULATION OF ASSEMBLY).

Anti-human F.IX antibody H chain genes Q153-G4d and Q153-z7 were constructed by linking respectively G4d and z7 downstream of Q153. Anti-human F.IX antibody H chain gene Q407-z106 was constructed by linking z106 downstream of Q407. Anti-human F. X antibody H chain gene J142-G4d, J142-z72, and J142-z73 were constructed by linking respectively G4d, z72, and z73 downstream of J142. Anti-human F. X antibody H chain gene J300-z107 was constructed by linking z107 downstream of J300. Anti-human interleukin-6 receptor antibody H chain gene MRA-G1d, MRA-z106, and MRA-z107 were constructed by linking respectively G1d, z106, and z107 downstream of MRA-VH.

The respective antibody genes (Q153-G4d, Q153-z7, Q407-z106, J142-G4d, J142-z72, J142-z73, J300-z106, MRA-G1d, MRA-z106, MRA-z107, L180-k, L210-k, and MRA-k) were inserted into animal cell expression vectors.

The following antibodies were transiently expressed in FreeStyle293 cells (Invitrogen) by transfection using the constructed expression vectors. As seen below, multiple antibody genes to be transfected were arranged and used as antibody names.
MRA-G1d/MRA-k
MRA-z106/MRA-z107/MRA-k
Q153-G4d/J142-G4d/L180-k
Q153-G4d/J142-z72/L180-k
Q153-z7/J142-z73/L180-k
Q407-z106/J300-z107/L210-k

[Reference Example 4] Assessment of Elution Condition for Heterodimerized Antibody in Protein a Affinity Chromatography, and Separation and Purification A FreeStyle293 cell culture medium (hereinafter abbreviated as CM) obtained by transient expression of Q153-G4d/J142-G4d/L180-k and Q153-G4d/J142-z72/L180-k was used as a sample to assess the elution condition in Protein A affinity chromatography. CM filtered through φ0.22-μm filter was loaded onto rProtein A Sepharose Fast Flow column (GE Healthcare) equilibrated with D-PBS. Washes 1 and 2, and Elutions 1 to 5 shown in Table 80 were performed in a stepwise manner. The quantity of CM to be loaded was adjusted in a way that the quantity of antibody loaded onto the column is 20 mg/ml resine. Fractions eluted under each condition were collected and the components in each elution fraction were identified by cation exchange chromatography analysis. To prepare controls, each CM was loaded onto rProtein G Sepharose Fast Flow resin (GE Healthcare). Samples purified by batchwise elution were used as controls. Since Protein G binds to the Fab domain of an antibody, all antibody species (bispecific antibody of interest in which two types of H chains are associated in a heteromeric manner (heteromeric antibody) and as an impurity monospecific homomeric antibodies in which single-type H chains are homomerically associated) in CM can be purified by using protein G, regardless of their Protein A-binding activity.

TABLE 80

| EQUILIBRATION | D-PBS |
|---|---|
| WASH 1 | 400 mM Arg-HCl/D-PBS |
| WASH 2 | 20 mM NaCitrate, pH 5.0 |
| ELUTION 1 | 20 mM NaCitrate, pH 4.0 |
| ELUTION 2 | 20 mM NaCitrate, pH 3.8 |
| ELUTION 3 | 20 mM NaCitrate, pH 3.6 |
| ELUTION 4 | 20 mM NaCitrate, pH 3.4 |
| ELUTION 5 | 20 mM NaCitrate, pH 3.2 |

CM in which Q153-G4d/J142-G4d/L180-k or Q153-G4d/J142-z72/L180-k had been expressed was eluted from a protein A column (Elutions 1 to 5), and the respective eluted fractions were analyzed by cation exchange chromatography. As for Q153-G4d/J142-G4d/L180-k, the analysis revealed that as the elution condition was altered from 1 to 5, i.e., as the pH of the elution buffer was reduced, the antibody composition of the eluted fractions changed gradually in the order from the homomeric antibody J142-G4d/L180-k to the heteromeric antibody Q153-G4d/J142-G4d/L180-k, and then to the homomeric antibody Q153-G4d/L180-k. The order of elution is understood to be in accordance with the strength of binding to Protein A. This implies that the Protein A-binding strength of homomeric antibody Q153-G4d/L180-k, which remained bound until a lower pH, is greater than homomeric species J142-G4d/L180-k (homomeric antibody against FX) which eluted at a high pH. Variable region J142 is known to be a sequence that does not bind to Protein A. Specifically, homomeric species J142-G4d/L180-k (homomeric antibody against FX) has two Protein A-binging sites; heteromeric antibody Q153-G4d/J142-G4d/L180-k has three Protein A-binging sites; and homomeric antibody Q153-G4d/L180-k (homomeric antibody against FIX) has four Protein A-binging sites. It was thus demonstrated that, more Protein A-binding sites resulted in stronger Protein A binding and thus a lower pH was required for elution.

Meanwhile, as for Q153-G4d/J142-z72/L180-k, it was revealed that as the elution condition was altered from 1 to 5, the antibody composition in the eluted fraction changed from the heteromeric antibody Q153-G4d/J142-z72/L180-k to the homomeric antibody Q153-G4d/L180-k. Homomeric antibody J142-z72/L180-k (homomeric antibody against FX) was almost undetectable in each elution fraction, and this indicates that it has no Protein A-binding ability. It is thought that the lack of protein A-binding ability of J142-z72 might be due to the introduced substitution mutation of Arg for His at position 435 (EU numbering). Homomeric antibody J142-z72/L180-k (homomeric antibody against FX) has no Protein A-binding site; heteromeric antibody Q153-G4d/J142-z72/L180-k has two Protein A-binding sites; and homomeric antibody Q153-G4d/L180-k (homomeric antibody against FIX) has four Protein A-binding sites. Since homomeric antibody J142-z72/L180-k (homomeric antibody against FX) flowed through without binding to Protein A and was not detected in each elution fraction. Furthermore, in both cases of Q153-G4d/J142-G4d/L180-k and Q153-G4d/J142-z72/L180-k, it was suggested that the heteromeric antibody and homomeric antibody Q153-G4d/L180-k (a homomeric antibody against FIX) were separable from each other at pH 3.6 or a lower pH.

Heterodimerized antibodies were purified by Protein A column chromatography under the purification conditions assessed as described above.

CM of the antibodies listed below were used as a sample.
- Q153-G4d/J142-G4d/L180-k
- Q153-G4d/J142-z72/L180-k
- Q153-z7/J142-z73/L180-k
- Q407-z106/J300-z107/L210-k CM filtered through φ0.22-μm filter was loaded onto rProtein A Sepharose Fast Flow column (GE Healthcare) equilibrated with D-PBS. Washes 1 and 2 and Elutions 1 and 2 shown in Table 81 were carried out (Elution 1 alone was performed for Q407-z106/J300-z107/L210-k). The elution condition was based on the result described above. The quantity of CM to be loaded was adjusted in a way that the quantity of the loaded antibody is 20 mg/ml resine. Fractions eluted under each condition were collected and the components contained in each elution fraction were identified by cation exchange chromatography analysis. In the same manner as shown in the result described above, each CM was loaded onto rProtein G Sepharose Fast Flow resin (GE Healthcare) to prepare controls. Samples purified by batch-wise elution were used as controls.

TABLE 81

| EQUILIBRATION | D-PBS |
| --- | --- |
| WASH 1 | 400 mM Arg-HCl/D-PBS |
| WASH 2 | 20 mM NaCitrate, pH 5.0 |
| ELUTION 1 | 20 mM NaCitrate, pH 3.6 |
| ELUTION 2 | 20 mM NaCitrate, pH 2.7 |

The results of cation exchange chromatography analysis for each eluted fraction are shown in Tables 82 to 85 below. The values represent the area of elution peak expressed in percentage. With respect to antibodies other than Q153-G4d/J142-G4d/L180-k, the homomeric antibody against FX was almost undetectable in any elution fraction. It was revealed that not only homomeric antibody J142-z72 (homomeric antibody against FX) but also homomeric antibodies J142-z73 and J300-z107 (homomeric antibodies against FX) did not bind to Protein A. It is thought that the lack of protein A-binding ability in the homomeric antibody against FX was due to the substitution mutation of Arg for His at position 435 (EU numbering), which was introduced into the H chain constant region of the antibody against FX. The heteromeric antibody, which is a bispecific antibody of interest, was mostly detected in the fraction of elution 1, while, although they were also detected at a very low level in the fraction of Elution 1, the homomeric antibody against FIX was mostly eluted by Elution 2. As compared to Q153-G4d/J142-z72/L180-k, in the cases of Q153-z7/J142-z73/L180-k and Q407-z106/J300-z107/L210-k, the proportion of the heteromeric antibody (bispecific antibody of interest) was considerably increased in the fraction eluted at pH 3.6. It was demonstrated that when a substitution mutation from Glu to Lys at position 356 (EU numbering) and a substitution mutation from Lys to Glu at position 439 (EU numbering) for the purpose of efficient formation of heteromeric molecules for respective H chains were introduced in addition to the substitution mutation from His to Arg at position 435 (EU numbering), the heteromeric antibody, which is a bispecific antibody of interest, could be purified to a purity of 98% or higher through the Protein A-based purification step alone.

The finding described above shows that, based on the difference in the number of Protein A-binding sites between homomeric antibody and heteromeric antibody, the heteromeric antibody can be efficiently separated and purified to high purity using Protein A chromatography step alone.

TABLE 82

Q153-G4d/J142-G4d/L180-k

| PEAK AREA (%) | CONTROL | pH 3.6 ELUTION FRACTION | pH 2.7 ELUTION FRACTION |
| --- | --- | --- | --- |
| J142-G4d/L180-k | 17.6 | 27.5 | — |
| Q153-G4d/J142-G4d/L180-k | 48.3 | 58.4 | 9.0 |
| Q153-G4d/L180-k | 34.1 | 14.1 | 91.0 |

TABLE 83

Q153-G4d/J142-z72/L180-k

| PEAK AREA (%) | CONTROL | pH 3.6 ELUTION FRACTION | pH 2.7 ELUTION FRACTION |
| --- | --- | --- | --- |
| J142-z72/L180-k | 8.4 | 0.9 | — |
| Q153-G4d/J142-z72/L180-k | 50.8 | 81.0 | 2.2 |
| Q153-G4d/L180-k | 40.8 | 18.1 | 97.8 |

TABLE 84

Q153-z7/J142-z73/L180-k

| PEAK AREA (%) | CONTROL | pH 3.6 ELUTION FRACTION | pH 2.7 ELUTION FRACTION |
| --- | --- | --- | --- |
| J142-z73/L180-k | 3.2 | — | — |
| Q153-z7/J142-z73/L180-k | 90.7 | 98.1 | 2.7 |
| Q153-z7/L180-k | 6.1 | 1.9 | 97.3 |

TABLE 85

Q407-z106/J300-z107/L210-k

| PEAK AREA (%) | CONTROL | pH 3.6 ELUTION FRACTION | pH 2.7 ELUTION FRACTION |
| --- | --- | --- | --- |
| J300-z107/L210-k | 5.8 | — | |
| Q407-z106/J300-z107/L210-k | 84.6 | 98.9 | |
| Q407-z106/L210-k | 9.7 | 1.1 | |

[Reference Example 5] Assessment of Altered Antibodies for Tm by Differential Scanning Fluorometry In this assessment, Tm of altered antibodies was evaluated by differential scanning fluorometry using Rotor-Gene Q (QIAGEN). This method has been reported to show an excellent correlation with Tm assessment using differential scanning calorimeter, which is a widely known method for assessing the thermal stability of antibodies (Journal of Pharmaceutical Science 2010, 4: 1707-1720).

After 5000 times concentrated SYPRO orange (Molecular Probes) was diluted with PBS (Sigma), antibody solutions were mixed with it to prepare measurement samples. 20 μL each of the samples were placed in measurement tubes and the temperature was increased at a temperature raising rate of 240° C./hr from 30° C. up to 99° C. The fluorescence change with increasing temperature was detected at 470 nm (excitation wavelength)/555 nm (fluorescent wavelength).

From the data, the temperature at which fluorescence transition was observed was calculated as Tm using Rotor-Gene Q Series Software (QIAGEN).

[Reference Example 6] Acceleration Test of Modified Heteromeric Antibodies

Acceleration tests were performed regarding the antibodies described in this Example and the storage stability was compared.

After purification with Protein A, antibodies were prepared at 1.0 mg/ml using PBS containing 0.2 mM hydrochloric acid, and stored in an incubator at 40° C. At the start of storage, after two weeks of storage, and after four weeks of storage, each antibody was assessed for the monomer content by size exclusion chromatography using G3000 $SW_{XL}$ column.

[Reference Example 7] ADCC Activity of Each Test Antibody Using Human Peripheral Mononuclear Cells as Effector Cells Variants with FcγR-binding activity increased by introducing an alteration into only one H chain of an antibody were assayed for ADCC activity according to the method described below.

ADCC of each test antibody was assayed using human peripheral blood mononuclear cells (hereinafter referred to as "human PBMC") as effector cells by the procedure described below.

(1) Preparation of Human PBMC Solutions

Using syringes pre-filled with 200 µl of 1,000 units/ml heparin solution (Novo-Heparin 5000 units for Injection; Novo Nordisk), 50 ml of peripheral blood was collected from healthy volunteers (male adult) affiliated with Chugai Pharmaceutical Co. Ltd. The peripheral blood was diluted two-fold with PBS(-), and divided into four equal parts, each of which was transferred into a pre-centrifuged leukocyte separation tube Leucosep (Greiner Bio-One) containing 15 ml of Ficoll-Paque PLUS. The separation tubes containing an aliquot of the peripheral blood were centrifuged at 2,150 rpm and room temperature for ten minutes. Then, the resulting mononuclear cell fractions were collected. The cells in each fraction was washed once with Dulbecco's Modified Eagle's Medium (SIGMA) containing 10% FBS (hereinafter referred to as "10% FBS/D-MEM"), and then suspended at a density of $5 \times 10^6$ cells/ml in 10% FBS/D-MEM. The cell suspensions were used as human PBMC solutions in the subsequent experiments.

(2) Preparation of Target Cells

SK-pca13a resulting from forced expression of human glypican-3 in SK-Hep-1 was detached from the dish, and 1.85 MBq of Cr-51 was added to $3 \times 10^6$ cells. Cells added with Cr-51 were incubated in an incubator under 5% carbon dioxide gas at 37° C. for one hour. Then the cells were washed once with 10% FBS/D-MEM, and suspended at a cell density of $2 \times 10^5$ cells/ml in 10% FBS/D-MEM. The cell suspension was used as target cells in the subsequent experiments.

(3) Chromium Release Test (ADCC Activity)

ADCC activity was assessed based on specific chromium release rate determined by chromium release assay. First, antibody solutions prepared at each concentration (0, 0.004, 0.04, 0.4, 4, and 40 µg/ml) were added in 50 µl to respective wells of a 96-well U-bottomed plate. Then, 50 µl-aliquots of the target cells prepared as described in (2) were plated ($1 \times 10^4$ cells/well) and allowed to stand at room temperature for 15 minutes. 100 µl of human PBMC solution prepared as described in (1) was added to each well ($5 \times 10^5$ cells/well). The plates were incubated under 5% carbon dioxide gas in a $CO_2$ incubator at 37° C. for four hours, and then centrifuged. 100 µl of culture supernatant in each well of the plates was measured for radioactivity using a gamma counter. The specific chrome release rate was determined by the following formula:

[Specific chrome release rate (%)]=$(A-C) \times 100/(B-C)$.

In this formula, "A" represents mean radioactivity (cpm) of 100 µl of culture supernatant in each well. "B" represents mean radioactivity (cpm) of 100 µl of culture supernatant in a well containing target cells, 100 µl of 2% NP-40 aqueous solution (Nonidet P-40; Nacalai Tesques), and 50 µl of 10% FBS/D-MEM. Furthermore, "C" represents mean radioactivity (cpm) of 100 µl of culture supernatant in a well containing target cells and 150 µl of 10% FBS/D-MEM. The test was conducted in triplicate. The mean and standard deviation of the specific chrome release rate (%) which reflects the ADCC of each test antibody were calculated based on the assay described above.

[Reference Example 8] Preparation of FcγR and Assessment of Binding Activity to FcγR Extracellular domains of FcgRs were prepared by the following method. First, a gene of the extracellular domain of FcgR was synthesized by a method well known to those skilled in the art. At that time, the sequence of each FcgR was produced based on the information registered at NCBI. Specifically, FcgRI was produced based on the sequence of NCBI Accession # NM_000566.3, FcgRIIa was produced based on the sequence of NCBI Accession # NM_001136219.1, FcgRIIb was produced based on the sequence of NCBI Accession # NM_004001.3, FcgRIIIa was produced based on the sequence of NCBI Accession # NM_001127593.1, and FcgRIIIb was produced based on the sequence of NCBI Accession # NM_000570.3, and a His tag was attached to the C terminus. Furthermore, polymorphism is known for FcgRIIa, FcgRIIIa, and FcgRIIIb, and the polymorphic sites were produced by referring to J. Exp. Med., 1990, 172: 19-25 for FcgRIIa; J. Clin. Invest., 1997, 100 (5): 1059-1070 for FcgRIIIa; and J. Clin. Invest., 1989, 84, 1688-1691 for FcgRIIIb.

The obtained gene fragments were inserted into an animal cell expression vector, and expression vectors were produced. The produced expression vectors were introduced transiently into human embryonic kidney cancer cell line-derived FreeStyle293 cells (Invitrogen) to express the proteins of interest. Regarding FcgRIIb used for crystallographic analysis, the protein of interest was expressed in the presence of Kifunesine at a final concentration of 10 µg/mL, so that the sugar chain added to FcgRIIb will be the high-mannose type. Cells were cultured, and after collection of the obtained culture supernatant, this was passed through a 0.22 µm filter to obtain the culture supernatant. In principle, the obtained culture supernatants were purified in the following four steps. The steps carried out were, cation exchange column chromatography (SP Sepharose FF) in step 1, affinity column chromatography (HisTrap HP) for His tag in step 2, gel filtration column chromatography (Superdex200) in step 3, and aseptic chromatography in step 4. However, for FcgRI, anion exchange column chromatography using Q sepharose FF was performed as step 1. The purified proteins were subjected to absorbance measurements at 280 nm using a spectrophotometer; and from the obtained values, the concentrations of the purified proteins were calculated using the absorption coefficient calculated using methods such as PACE (Protein Science 1995; 4: 2411-2423).

Analysis of interaction between objective antibody and the FcγR was carried out using Biacore T100 (GE Healthcare), Biacore T200, Biacore A100, and Biacore 4000. HBS-EP+ (GE Healthcare) was used as the running buffer, and the measurement temperature was set to 25° C. Chips produced by immobilizing the antigen peptide by the amine coupling method to a Series S sensor Chip CM5 (GE Healthcare), chips produced by allowing preliminarily biotinylated antigen peptides to interact with and immobilize onto a Series S Sensor Chip SA (certified) (GE Healthcare), chips produced by immobilizing Protein L (ACTIGEN, BioVision) to Series S Sencor Chip CM5 (GE Healthcare), or chips produced by immobilizing Protein A/G (Thermo Scientific) to Series S Sencor Chip CM5 (GE Healthcare) were used. Antibodies of interest were captured onto these chips, and allowed to interact to each FcγR diluted with running buffer. To regenerate and repeatedly use the chip, the antibodies captured onto the chip were washed off by reacting 10 mM glycine-HCl, pH 1.5.

The FcγR-binding activity of each antibody was assessed primarily using as an indicator the FcγR-binding activity and dissociation constant for FcγR.

The FcγR-binding activity refers to the relative binding activity to FcγR. Regarding the relative FcγR-binding activity, in each measurement the binding activity of a control sample was taken as 100(%) to calculate the binding activities of other antibodies. The binding activity described above was defined as a value obtained by dividing the level of change in the sensorgram before and after interaction of FcγR to the captured antibody by the quantity of each captured antibody. The reason is that the binding activity of FcγR depends on the quantity of the captured antibody.

The dissociation constant of each antibody for FcγR was calculated by performing kinetic analysis of the result of Biacore measurement. Specifically, to calculate association rate constant ka (L/mol/s) and dissociation rate constant kd(1/s), sensorgrams obtained by measurement were processed for global fitting by Biacore Evaluation Software using 1:1 Langmuir binding model. Dissociation constant KD (mol/l) was calculated from the resulting values.

[Reference Example 9] ADCC Activity of Each Test Antibody Using Human Peripheral Blood Mononuclear Cells as Effector Cells Each variant with Fc alteration is assayed for their ADCC activity according to the method described below.

ADCC activity of each test antibody was assayed using human peripheral blood mononuclear cells (hereinafter referred to as "human PBMC") as effector cells by the procedure described below.

(1) Preparation of Human PBMC Solutions

Using syringes pre-filled with 200 μl of 1,000 units/ml heparin solution (Novo-Heparin 5000 units for Injection; Novo Nordisk), 50 ml of peripheral blood was collected from healthy volunteers (male adult) affiliated with Chugai Pharmaceutical Co. Ltd. The peripheral blood was diluted two-fold with PBS(–), and divided into four equal parts, each of which was transferred into a pre-centrifuged leukocyte separation tube Leucosep (Greiner Bio-One) containing 15 ml of Ficoll-Paque PLUS. The separation tubes containing an aliquot of the peripheral blood were centrifuged at 2,150 rpm and room temperature for ten minutes. Then, the resulting mononuclear cell fractions were collected. The cells in each fraction was washed once with Dulbecco's Modified Eagle's Medium (SIGMA) containing 10% FBS (hereinafter referred to as "10% FBS/D-MEM"), and then suspended at a density of $5 \times 10^6$ cells/ml or $2.5 \times 10^6$ cells/ml in 10% FBS/D-MEM. The cell suspensions were used as human PBMC solutions in the subsequent experiments.

(2) Preparation of Target Cells

SK-pca13a resulting from forced expression of human Epiregulin in SK-Hep-1, SKE18, human colon cancer cell line DLD-1, or human pancreas cell line MIAPaCa-2 were detached from the dish, and 200 μL of 0.2 mg/mL Calcein solution was added to $1 \times 10^6$ cells or 1.85 MBq of Cr-51 was added to $3 \times 10^6$ cells. Cells added with Calcein or Cr-51 were incubated in an incubator under 5% carbon dioxide gas at 37° C. for one or two hours. Then, the cells were washed once with 10% FBS/D-MEM, and suspended at a cell density of $2 \times 10^5$ cells/ml in 10% FBS/D-MEM. The cell suspension was used as target cells in the subsequent experiments.

(3-1) Calcein or Chromium Release Assay (ADCC Activity)

ADCC activity was assessed based on specific Calcein or chromium release rate determined by Calcein or chromium release assay. First, antibody solutions prepared at each concentration (0, 0.004, 0.04, 0.4, 4, and 40 μg/ml) were added in 50 μl to respective wells of a 96-well U-bottomed plate. Then, 50 μl-aliquots of the target cells prepared as described in (2) were plated ($1 \times 10^4$ cells/well) and allowed to stand at room temperature for 15 minutes. 100 μl of human PBMC solution prepared as described in (1) was added to each well ($5 \times 10^5$ cells/well or $2.5 \times 10^5$ cells/well). The plates were incubated under 5% carbon dioxide gas in a $CO_2$ incubator at 37° C. for four hours, and then centrifuged. 100 μl of culture supernatant in each well of the plates was measured for Calcein fluorescence and radioactivity using a absorptionmeter and gamma counter. The specific chrome release rate was determined by the following formula:

[Specific Calcein or chrome release rate (%)]=$(A-C) \times 100/(B-C)$.

In this formula, "A" represents mean Calcein fluorescence (excitation wavelength: 485 nm; fluorescence wavelength: 535 nm) or mean radioactivity (cpm) of 100 μl of culture supernatant in each well. "B" represents mean Calcein fluorescence (excitation wavelength: 485 nm; fluorescence wavelength: 535 nm) or mean radioactivity (cpm) of 100 μl of culture supernatant in a well containing target cells, 100 μl of 2% NP-40 aqueous solution (Nonidet P-40; Nacalai Tesques), and 50 μl of 10% FBS/D-MEM. Furthermore, "C" represents mean Calcein fluorescence (excitation wavelength: 485 nm; fluorescence wavelength: 535 nm) or mean radioactivity (cpm) of 100 μl of culture supernatant in a well containing target cells and 150 μl of 10% FBS/D-MEM. The test was conducted in triplicate. The mean and standard deviation of the specific Calcein or chrome release rate (%) which reflects the ADCC of each test antibody were calculated based on the assay described above.

INDUSTRIAL APPLICABILITY

The present invention provides polypeptides that are suitable for pharmaceuticals, which are polypeptides whose binding activities have been modified by altering amino acid sequences of an antibody constant region and whose physical properties (for example, stability and homogeneity) have been improved.

SEQUENCE LISTING (205 sequences)

SEQ ID NO: 1 - protein, 115 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSS

SEQ ID NO: 2 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 3 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 4 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 5 - protein, 219 aa, Artificial
  An artificially synthesized peptide sequence
DIVMTQSPLSLPVTPGEPASISCQASESLVHSNRNTYLHWYLQKPGQSPQLLIYKVSNRFSGVPDRFSGSGSGTDFTLKISRVEAEDVGVYYCSQNTHVPPTFGQGTKVEIERTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 7 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGLPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 8 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAEPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 9 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKADPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 10 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEELGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 11 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEDLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 12 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALRAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 13 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALKAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 14 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALDAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 15 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALEAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 16 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALRAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 17 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALRAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 18 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEDLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALRAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 19 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALRAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 20 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLWGPSVFLFPPKPKDTLMISRTPEVTCVVVDVSHEDPEVKFNWYVDGVEVHNAKTKPREEQYNSTYRVVSVLTVLHQDWLNGKEYKCKVSNKALRAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 21 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALRAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 22 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 23 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLWGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 24 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 25 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 26 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLWGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 27 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 28 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLWGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 29 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 30 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLWGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 31 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLWGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 32 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLWGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 33 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLWGPSVFLFPPKPKDTLMISRTPEVTCVVVDVSHEDPEVKFNWYVDGVEVHNAKTKPREEQYNATYRVVSVLTVLHQDWLNGKEYKCKVSNKALRAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 34 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALRAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 35 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALRLPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 36 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALRAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 37 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 38 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPLPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 39 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 40 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 41 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 42 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 43 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLWGPDVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 44 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLWGPSVFLFPPKPKDTLMISRTPEVTCVVVDVSHEDPEVKFNWYVDGVEVHNAKTKPREEQWNATYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 45 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQWNSTYRVVSVLTVLHQDWLNGKEYKCKVSNKALPLPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 46 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLWGPDVFLFPPKPKDTLMISRTPEVTCVVVDVSHEDPEVKFNWYVDGVEVHNAKTKPREEQWNATYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 47 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLWGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEGTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 48 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEGTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 49 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 50 - protein, 443 aa, Artificial; identical to SEQ ID NO: 39
  An artificially synthesized peptide sequence

SEQ ID NO: 51 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 52 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 53 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 54 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYAGPSVFLFPPKPKDTLMISRTPEVTCVVVDVSDEDPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 55 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYAGPSVFLFPPKPKDTLMISRTPEVTCVVVDVSDEDPEVKFNWYVDGVEVHNAKTKPREELYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 56 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 57 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 58 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 59 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPKPEEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 60 - protein, 443 aa, Artificial
  An artificially synthesized peptide sequence
QVQLVQSGAEVKKPGASVTVSCKASGYTFTDYEMHWIRQPPGEGLEWIGAIDPKTGDTAYSESFQDRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLAGPDVFLFPPKPKDTLMISRTPEVTCVVVDVSHEDPEVKFNWYVDGVEVHNAKTKPREELYNSTYRVVSVLTVLHQDWLNGKEYKCKVSNKALPMPEEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 61 - protein, 123 aa, Artificial
  An artificially synthesized peptide sequence
QVQLVESGGGLVQPGGSLRLSCAASGFTFSYYDINWVRQAPGKGLEWVASISPSGGSTYYRRSVKGRFTISRDNAKNSLYLQMNSLRAEDTAVYYCATRAGHNYGAGWYFDYWGQGTLVTVSS

SEQ ID NO: 62 - protein, 123 aa, Artificial
  An artificially synthesized peptide sequence
QVQLVESGGGLVQPGGSLRLSCAASGFTFSYYDINWVRQAPGKGLEWVSSISPSGQSTYYRREVKGRFTISRDNSKNTLYLQMNSLRAEDTAVYYCARRAGHNYGAGWYFDYWGQGTLVTVSS

SEQ ID NO: 63 - protein, 119 aa, Artificial
  An artificially synthesized peptide sequence
QVQLVQSGSELKKPGASVKVSCKASGYTFTDNNMDWVRQAPGQGLEWMGDINTRSGGSIYNEEFQDRVTMTIDKSTGTAYMELSSLRSEDTAVYYCARRRSYGYYHDEWGEGTLVTVSS

SEQ ID NO: 64 - protein, 119 aa, Artificial
  An artificially synthesized peptide sequence
QVQLVQSGSELKKPGASVKVSCKASGYTFTDNNMDWVRQAPGQGLEWMGDINTRSGGSIYNEEFQDRVIMTVDKSTDTAYMELSSLRSEDTAVYHCARRKSYGYYLDEWGEGTLVTVSS

SEQ ID NO: 65 - protein, 119 aa, Artificial [sequence omitted]

SEQ ID NO: 66 - protein, 214 aa, Artificial
  An artificially synthesized peptide sequence
DIQMTQSPSSLSASVGDRVTITCKASRNIERNLAWYQQKPGQAPELLIYSASRKESGVPDRFSGSRYGTDFTLTISSLQPEDLATYYCQQYYSPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 67 - protein, 214 aa, Artificial
  An artificially synthesized peptide sequence
DIQMTQSPSSLSASVGDRVTITCKASRNIERNLAWYQQKPGQAPELLIYSASRKESGVPDRFSGSRYGTDFTLTISSLQPEDIATYYCQQYSSPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 68 - protein, 214 aa, Artificial [sequence omitted]

SEQ ID NO: 69 - protein, 325 aa, Artificial
  An artificially synthesized peptide sequence
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSL

SEQ ID NO: 70 - protein, 325 aa, Artificial
  An artificially synthesized peptide sequence
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSP

SEQ ID NO: 71 - protein, 325 aa, Artificial
  An artificially synthesized peptide sequence
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSRLTVDKSRWQEGNVFSCSVMHEALHNHYTQKSLSLSL

SEQ ID NO: 72 - protein, 325 aa, Artificial
  An artificially synthesized peptide sequence
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQESLSLSP

SEQ ID NO: 73 - protein, 325 aa, Artificial
  An artificially synthesized peptide sequence
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNHYTQKSLSLSL

SEQ ID NO: 74 - protein, 325 aa, Artificial
  An artificially synthesized peptide sequence
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNRYTQESLSLSP

SEQ ID NO: 75 - protein, 328 aa, Artificial
  An artificially synthesized peptide sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 76 - protein, 330 aa, Homo sapiens [sequence omitted]

SEQ ID NO: 77 - protein, 326 aa, Homo sapiens
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 78 - protein, 377 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 79 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 80 - protein, 116 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSS

SEQ ID NO: 81 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPSVFLFPPKPKDTLMISRTPEVTCVVVDVSDEDPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 82 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNDALPMPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 83 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 84 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 85 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 86 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 87 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 88 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPSVFLFPPKPKDTLMISRTPEVTCVVVDVSDEDPEVKFNWYVDGVEVHNAKTKPREEQYNATYRVVSVLTVLHQDWLNGKEYKCKVSNKALPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 89 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNDALPMPIEETISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 90 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPSVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 91 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPMPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 92 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEENWGPSVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 93 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 94 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 95 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPSVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 96 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPKPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 97 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPSVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 98 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPKPIEETISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 99 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 100 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYQWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 101 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 102 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 103 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 104 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPSVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 105 - protein, 444 aa, Artificial Sequence
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 106 - protein, 213 aa, Artificial Sequence
  An artificially synthesized peptide sequence
DIQMTQSPSSLSASVGDRVTITCRASQDIHKYIAWYQQKPGQAPRLLIQYTSTLQPGVPSRFSGSGSGTDYTFTISSLQPEDIATYYCLQYEQLRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 107 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPMVFLFPPKPKDTLMISRTPEVTCVVVDVSDEDPEVKFNWYVDGVEVHNAKTKPREKQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 108 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPMVFLFPPKPKDTLMISRTPEVTCVVVDVSDEDPEVKFNWYVDGVEVHNAKTKPRERQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 109 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLSGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPKPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 110 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLVGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPKPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 111 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLIGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPKPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 112 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLTGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPKPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 113 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYNWGPMVFLFPPKPKDTLMISRTPEVTCVVVDVSDEDPEVKFNWYVDGVEVHNAKTKPREKQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 114 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYNWGPMVFLFPPKPKDTLMISRTPEVTCVVVDVSDEDPEVKFNWYVDGVEVHNAKTKPRERQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 115 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLTGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPKPEEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 116 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDWPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 117 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPQEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 118 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEYTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 119 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDAPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 120 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPMEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 121 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDWPAPIELTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 122 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDAWPKPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 123 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDAAPKPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 124 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPKPEEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 125 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPKPTEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 126 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPHPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPKPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 127 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPKPQEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 128 - protein, 119 aa, Artificial
  An artificially synthesized peptide sequence
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSS

SEQ ID NO: 129 - protein, 447 aa, Artificial
  An artificially synthesized peptide sequence
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 130 - protein, 447 aa, Artificial
  An artificially synthesized peptide sequence
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 131 - protein, 447 aa, Artificial
  An artificially synthesized peptide sequence
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPDLLGDDSVFLFPPKPKDTLMISRTPEVTCVVVDVSDEDGEVKFNWYVDGVEVHNAKTKPREEQYNSTYRVVSVLTVLHQDWLNGKEYKCKVSNKALPRPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 132 - protein, 447 aa, Artificial
  An artificially synthesized peptide sequence
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVEHEDPEVKFNWYVDGVEVHNAKTKPREEQYNSTYRVVSVLTVLHQDWLNGKEYKCKVSNKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 133 - protein, 214 aa, Artificial [sequence omitted]

SEQ ID NO: 134 - protein, 447 aa, Artificial
  An artificially synthesized peptide sequence
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPDLLGDDDVFLFPPKPKDTLMISRTPEVTCVVVDVSDEDGEVKFNWYVDGVEVHNAKTKPREEQYNSTYRVVSVLTVLHQDWLNGKEYKCKVSNKALPRPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 135 - protein, 447 aa, Artificial
  An artificially synthesized peptide sequence
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPDLLGDDEVFLFPPKPKDTLMISRTPEVTCVVVDVSDEDGEVKFNWYVDGVEVHNAKTKPREEQYNSTYRVVSVLTVLHQDWLNGKEYKCKVSNKALPRPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 136 - protein, 447 aa, Artificial
  An artificially synthesized peptide sequence
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 137 - protein, 447 aa, Artificial
  An artificially synthesized peptide sequence
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPDLLGDDSVFLFPPKPKDTLMISRTPEVTCVVVDVSDEDGEVKFNWYVDGVEVHNAKTKPREEQYNSTYRVVSVLTVLHQDWLNGKEYKCKVSNKALPRPIEKTISKAKGQPREPQVYTLPPSRKELTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 138 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYICNVNHKPSNTKVDKKVEPKSCDKTHTCPPCPAPEYYWGPSVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 139 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYICNVNHKPSNTKVDKKVEPKSCDKTHTCPPCPAPEYYWGPSVFLFPPKPKDTLMISRTPEVTCVVVDVSDEEPKVKFNWYVDGVEVHNAKTKPREEQYNATYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 140 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVEPKSCDKTHTCPPCPAPEYYWGPSVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVYTLPPSRKEKTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 141 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVEPKSCDKTHTCPPCPAPEYYWGPSVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVYTLPPSRKEKTKNQVSLTCLVKGFYPSDIAVEWESNGQPENNYKTTPPKLDSDGSFFLYSKLTVDKSRWQQGNVFSCSVMHEALHNRYTQKSLSLSP

SEQ ID NO: 142 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVEPKSCDKTHTCPPCPAPEYYWGPSVFLFPPKPKDTLMISRTPEVTCVVVDVSDEEPKVKFNWYVDGVEVHNAKTKPREEQYNATYRVVSVLTVLHQDWLNGKEYKCKVSNKALPAPIEKTISKAKGQPREPQVYTLPPSRKEKTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 143 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVEPKSCDKTHTCPPCPAPEYYWGPSVFLFPPKPKDTLMISRTPEVTCVVVDVSDEEPKVKFNWYVDGVEVHNAKTKPREEQYNATYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLDSDGSFFLYSKLTVDKSRWQQGNVFSCSVMHEALHNRYTQKSLSLSP

SEQ ID NO: 144 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVQFNWYVDGVEVHNAKTKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 145 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSEGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVQFNWYVDGVEVHNAKTKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 146 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVDHKPSNTKVDKKVEPKSCDKTHTCPPCPAPELLGGPSVFLFPPKPKDTLMISRTPEVTCVVVDVSHEEPEVQFNWYVDGVEVHNAKTKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 147 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSEGTAALGCLVKDYFPEPVTVSWNSGALTSGVHTFPAVLQSSGLYSLSSVVTVPSSSLGTQTYICNVDHKPSNTKVDKKVEPKSCDKTHTCPPCPAPELLGGPSVFLFPPKPKDTLMISRTPEVTCVVVDVSHEEPEVQFNWYVDGVEVHNAKTKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 148 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVEDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVQFNWYVDGVEVHNAKTKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 149 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVQFNWYVDGVEVHNAETKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 150 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGETAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVQFNWYVDGVEVHNAKTKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 151 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVQFNWYVDGVEVHNAKTKPREEQYNSTYRVVSVLTVLHQDWLNGKEYKCKVSNDALPMPIEETISKAKGQPREPQVYTLPPSREEMTKNQVSLTCLVKGFYPSDIAVEWESEGQPENNYKTTPPVLDSDGSFFLYSKLTVDKSRWQQGNVFSCSVMHEALHNHYTQESLSLSP

SEQ ID NO: 152 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKTVEPKSCDKTHTCPPCPAPELLGGPSVFLFPPKPKDTLMISRTPEVTCVVVDVSHEEPEVQFNWYVDGVEVHNAKTKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 153 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSEGTAALGCLVEDYFPEPVTVSWNSGALTSGVHTFPAVLQSSGLYSLSSVVTVPSSSLGTQTYICNVDHKPSNTKVDKKVEPKSCDKTHTCPPCPAPELLGGPSVFLFPPKPKDTLMISRTPEVTCVVVDVSHEEPEVQFNWYVDGVEVHNAETKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 154 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGETAALGCLVEDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVQFNWYVDGVEVHNAETKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 155 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDKTHTCPPCPAPELLGGPSVFLFPPKPKDTLMISRTPEVTCVVVDVSHEEPEVQFNWYVDGVEVHNAKTKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 156 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSESTAALGCLVKDYFPEPVTVSWNSGALTSGVHTFPAVLQSSGLYSLSSVVTVPSSNFGTQTYTCNVDHKPSNTKVDKTVEPKSCDKTHTCPPCPAPELLGGPSVFLFPPKPKDTLMISRTPEVTCVVVDVSHEEPEVQFNWYVDGVEVHNAETKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 157 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGETAALGCLVEDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVQFNWYVDGVEVHNAETKPREEQYNSTYRVVSVLTVLHQDWLNGKEYKCKVSNDALPMPIEETISKAKGQPREPQVYTLPPSREEMTKNQVSLTCLVKGFYPSDIAVEWESEGQPENNYKTTPPVLDSDGSFFLYSKLTVDKSRWQQGNVFSCSVMHEALHNHYTQESLSLSP

SEQ ID NO: 158 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSESTAALGCLVEDYFPEPVTVSWNSGALTSGVHTFPAVLQSSGLYSLSSVVTVPSSNFGTQTYTCNVDHKPSNTKVDKTVEPKSCDKTHTCPPCPAPELLGGPSVFLFPPKPKDTLMISRTPEVTCVVVDVSHEEPEVQFNWYVDGVEVHNAETKPREEQYNSTYRVVSVLTVLHQDWLNGKEYKCKVSNDALPMPIEETISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQESLSLSP

SEQ ID NO: 159 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSESTAALGCLVEDYFPEPVTVSWNSGALTSGVHTFPAVLQSSGLYSLSSVVTVPSSNFGTQTYTCNVDHKPSNTKVDKTVEPKSCDKTHTCPPCPAPELLGGPSVFLFPPKPKDTLMISRTPEVTCVVVDVSHEEPEVQFNWYVDGVEVHNAETKPREEQYNSTYRVVSVLTVLHQDWLNGKEYKCKVSNDALPMPIEETISKAKGQPREPQVYTLPPSREEMTKNQVSLTCLVKGFYPSDIAVEWESEGQPENNYKTTPPVLDSDGSFFLYSKLTVDKSRWQQGNVFSCSVMHEALHNHYTQESLSLSP

SEQ ID NO: 160 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGPSVFLFPPKPKDTLMISRTPEVTCVVVDVSHEDPEVKFNWYVDGVEVHNAKTYPREEQWNSTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 161 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPAPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 162 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPMPIEVTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 163 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEVTISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 164 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPFPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 165 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPIPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 166 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPYPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 167 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEEPEVKFNWYVDGVEVHNAKTKPREEQYNSTYRVVSVLTVLHQDWLNGKEYKCKVSNDALPHPIEETISKAKGQPREPQVYTLPPSRCELTKNQVSLSCAVKGFYPSDIAVEWESNGQPENNYKTTPPVLDSDGSFFLVSKLTVDKSRWQQGNVFSCSVMHEALHNHYTQKSLSLSP

SEQ ID NO: 168 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 169 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPESYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 170 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 171 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 172 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPESQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 173 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 174 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 175 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 176 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYLGGPSVFLFPPKPKDTLMISRTPEVTCVVVDVSHEDPEVKFNWYVDGVEVHNAKTKPREEQWNCTYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 177 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEVQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 178 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEDQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 179 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEQQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 180 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEIQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 181 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEMQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 182 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPETQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 183 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 184 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEGQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 185 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEHQWGPMVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 186 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEVYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 187 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEDYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 188 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEQYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 189 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEIYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 190 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEMYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 191 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPETYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 192 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 193 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEGYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 194 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEHYWGPMVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 195 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYQWGPIVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 196 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFQWGPIVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 197 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEQWGPIVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 198 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEDQWGPIVFLFPPKPKDTLMISRTPEVTCVVVDVSDEEPEVKFNWYVDGVEVHNAKTKPREEQYNATYRVVSVLTVLHQDWLNGKEYKCKVSNKALPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 199 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEYYWGPIVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 200 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEVYWGPIVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 201 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEIYWGPIVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 202 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELYWGPIVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 203 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEEYWGPIVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 204 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEDYWGPIVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

SEQ ID NO: 205 - protein, 444 aa, Artificial
  An artificially synthesized peptide sequence
QDQLVQSGAEVKKPGASVKVSCKASGFNIKDTYIQWVRQAPGQGLEWMGRIDPLRKQTKYREKFEGRVTITADTSTNTAYMELSSLRSEDTAVYYCVRSGREFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFYWGPIVFLFPPKPKDTLMISRTPEVTCVVVDVSDEDPEVKFNWYVDGVEVHNAKTKPREEQYNATYRVVSVLTVLHQDWLNGKEYKCKVSNKDLPAPIEKTISKAKGQPREPQVCTLPPSRDELTKNQVSLWCLVKGFYPSDIAVEWESNGQPENNYKTTPPVLDSDGSFFLYSKLTVDKSRWQQGNVFSCSVMHEALHNHYTQKSLSLSP

The invention claimed is:

1. A heterodimer comprising a first polypeptide and a second polypeptide,
wherein the first polypeptide comprises an IgG Fc region comprising a set of amino acids selected from the group consisting of sets (a) to (aj) below (all positions by EU numbering):
(a) amino acid E at position 234; amino acid Y at position 235; amino acid W at position 236; amino acid M at position 239; amino acid D at position 268; amino acid A at position 298; amino acid D at position 327;
(b) amino acid S at position 234; amino acid Y at position 235; amino acid W at position 236; amino acid M at position 239; amino acid D at position 268; amino acid A at position 298; and amino acid D at position 327;
(c) amino acid L at position 234; amino acid Q at position 235; amino acid W at position 236; amino acid M at position 239; amino acid D at position 268; amino acid E at position 270; and amino acid A at position 298;
(d) amino acid L at position 234; amino acid Y at position 235; amino acid W at position 236; amino acid M at position 239; amino acid D at position 268; amino acid A at position 298; and amino acid D at position 327;
(e) amino acid S at position 234; amino acid Q at position 235; amino acid W at position 236; amino acid M at position 239; amino acid D at position 268; amino acid E at position 270; and amino acid A at position 298;
(f) amino acid F at position 234; amino acid Q at position 235; amino acid W at position 236; amino acid M at position 239; amino acid D at position 268; amino acid E at position 270; and amino acid A at position 298;
(g) amino acid E at position 234; amino acid Q at position 235; amino acid W at position 236; amino acid M at position 239; amino acid D at position 268; amino acid E at position 270; and amino acid A at position 298;
(h) amino acid F at position 234; amino acid Y at position 235; amino acid W at position 236; amino acid M at position 239; amino acid D at position 268; amino acid A at position 298; and amino acid D at position 327;
(i) amino acid V at position 234; amino acid Q at position 235; amino acid W at position 236; amino acid M at position 239; amino acid D at position 268; amino acid E at position 270; and amino acid A at position 298;
(j) amino acid D at position 234; amino acid Q at position 235; amino acid W at position 236; amino acid M at position 239; amino acid D at position 268; amino acid E at position 270; and amino acid A at position 298;
(k) amino acid Q at position 234; amino acid Q at position 235; amino acid W at position 236; amino acid M at position 239; amino acid D at position 268; amino acid E at position 270; and amino acid A at position 298;
(l) amino acid I at position 234; amino acid Q at position 235; amino acid W at position 236; amino acid M at position 239; amino acid D at position 268; amino acid E at position 270; and amino acid A at position 298;
(m) amino acid M at position 234; amino acid Q at position 235; amino acid W at position 236; amino acid M at position 239; amino acid D at position 268; amino acid E at position 270; and amino acid A at position 298;
(n) amino acid T at position 234; amino acid Q at position 235; amino acid W at position 236; amino acid M at position 239; amino acid D at position 268; amino acid E at position 270; and amino acid A at position 298;
(o) amino acid A at position 234; amino acid Q at position 235; amino acid W at position 236; amino acid M at position 239; amino acid D at position 268; amino acid E at position 270; and amino acid A at position 298;
(p) amino acid G at position 234; amino acid Q at position 235; amino acid W at position 236; amino acid M at position 239; amino acid D at position 268; amino acid E at position 270; and amino acid A at position 298;
(q) amino acid H at position 234; amino acid Q at position 235; amino acid W at position 236; amino acid M at position 239; amino acid D at position 268; amino acid E at position 270; and amino acid A at position 298;
(r) amino acid V at position 234; amino acid Y at position 235; amino acid W at position 236; amino acid M at position 239; amino acid D at position 268; amino acid A at position 298; and amino acid D at position 327;
(s) amino acid D at position 234; amino acid Y at position 235; amino acid W at position 236; amino acid M at position 239; amino acid D at position 268; amino acid A at position 298; and amino acid D at position 327;
(t) amino acid Q at position 234; amino acid Y at position 235; amino acid W at position 236; amino acid M at position 239; amino acid D at position 268; amino acid A at position 298; and amino acid D at position 327;
(u) amino acid I at position 234; amino acid Y at position 235; amino acid W at position 236; amino acid M at position 239; amino acid D at position 268; amino acid A at position 298; and amino acid D at position 327;
(v) amino acid M at position 234; amino acid Y at position 235; amino acid W at position 236; amino acid M at position 239; amino acid D at position 268; amino acid A at position 298; and amino acid D at position 327;
(w) amino acid T at position 234; amino acid Y at position 235; amino acid W at position 236; amino acid M at position 239; amino acid D at position 268; amino acid A at position 298; and amino acid D at position 327;
(x) amino acid A at position 234; amino acid Y at position 235; amino acid W at position 236; amino acid M at position 239; amino acid D at position 268; amino acid A at position 298; and amino acid D at position 327;
(y) amino acid G at position 234; amino acid Y at position 235; amino acid W at position 236; amino acid M at position 239; amino acid D at position 268; amino acid A at position 298; and amino acid D at position 327;
(z) amino acid H at position 234; amino acid Y at position 235; amino acid W at position 236; amino acid M at position 239; amino acid D at position 268; amino acid A at position 298; and amino acid D at position 327;
(aa) amino acid F at position 234; amino acid Q at position 235; amino acid W at position 236; amino acid I at position 239; amino acid D at position 268; amino acid E at position 270; and amino acid A at position 298;
(ab) amino acid E at position 234; amino acid Q at position 235; amino acid W at position 236; amino acid I at position 239; amino acid D at position 268; amino acid E at position 270; and amino acid A at position 298;
(ac) amino acid D at position 234; amino acid Q at position 235; amino acid W at position 236; amino acid I at position 239; amino acid D at position 268; amino acid E at position 270; and amino acid A at position 298;
(ad) amino acid V at position 234; amino acid Y at position 235; amino acid W at position 236; amino acid I at position 239; amino acid D at position 268; amino acid A at position 298; and amino acid D at position 327;
(ae) amino acid I at position 234; amino acid Y at position 235; amino acid W at position 236; amino acid I at position 239; amino acid D at position 268; amino acid A at position 298; and amino acid D at position 327;
(af) amino acid L at position 234; amino acid Y at position 235; amino acid W at position 236; amino acid I at position 239; amino acid D at position 268; amino acid A at position 298; and amino acid D at position 327;
(ag) amino acid E at position 234; amino acid Y at position 235; amino acid W at position 236; amino acid I at position 239; amino acid D at position 268; amino acid A at position 298; and amino acid D at position 327;
(ah) amino acid D at position 234; amino acid Y at position 235; amino acid W at position 236; amino acid I at position 239; amino acid D at position 268; amino acid A at position 298; and amino acid D at position 327;
(ai) amino acid F at position 234; amino acid Y at position 235; amino acid W at position 236; amino acid I at position 239; amino acid D at position 268; amino acid A at position 298; and amino acid D at position 327; and
(aj) amino acid T at position 234; amino acid Y at position 235; amino acid W at position 236; amino acid I at position 239; amino acid D at position 268; amino acid A at position 298; and amino acid D at position 327; and
the second polypeptide comprises an IgG Fc region that is different from the Fc region of the first polypeptide and comprises a set of amino acids selected from the group consisting of sets (ak) to (aq) (all positions by EU numbering):
(ak) amino acid E at position 270; amino acid D at position 326; amino acid K at position 330; and amino acid E at position 334;
(al) amino acid E at position 270; amino acid D at position 326; amino acid M at position 330; and amino acid E at position 334;
(am) amino acid E at position 270; amino acid D at position 326; amino acid A at position 330; and amino acid E at position 334;
(an) amino acid E at position 270; amino acid D at position 326; amino acid F at position 330; and amino acid E at position 334;
(ao) amino acid E at position 270; amino acid D at position 326; amino acid I at position 330; and amino acid E at position 334;
(ap) amino acid E at position 270; amino acid D at position 326; amino acid Y at position 330; and amino acid E at position 334; and
(aq) amino acid E at position 270; amino acid D at position 326; amino acid H at position 330; and amino acid E at position 334.

2. The heterodimer of claim 1, wherein the amino acid sequence of the first polypeptide differs from the amino acid sequence of the second polypeptide at one or more additional positions selected from the group consisting of positions 137, 138, 139, 147, 192, 193, 196, 198, 199, 203, 214, 231, 233, 242, 263, 272, 274, 278, 288, 290, 316, 317, 320, 324, 335, 337, 338, 340, 341, 358, 360, 362, 364, 383, 384, 385, 386, 387, 390, 397, and 422 (all positions by EU numbering), wherein the difference at each such additional position increases the difference between isoelectric points of the first polypeptide and the second polypeptide.

3. The heterodimer of claim 2, wherein the one or more additional positions comprise mutation(s) in either the first or second polypeptide at EU numbering position(s) selected from the group consisting of positions 196, 199, 231, 233, 242, 263, 272, 316, 358, 364, 383, 387, and 397, and further comprise mutation(s) in the other polypeptide at EU numbering position(s) selected from the group consisting of positions 137, 138, 139, 147, 192, 193, 198, 199, 203, 214, 274, 278, 288, 290, 316, 317, 320, 324, 335, 337, 338, 340, 341, 358, 360, 362, 383, 384, 385, 386, 390, and 422, with all of said mutations being mutations relative a naturally occurring IgG Fc region amino acid sequence.

4. The heterodimer of claim 1, wherein the heterodimer is an antigen-binding molecule.

5. The heterodimer of claim 4, wherein the antigen-binding molecule is an antibody, a bispecific antibody, or an Fc fusion molecule.

6. A pharmaceutical composition comprising the heterodimer of claim 1 and a pharmaceutically acceptable carrier.

7. The heterodimer of claim 1, wherein, in the first polypeptide, the amino acid at position 234 (EU numbering) is E, D, T, or L, and the amino acid at position 327 (EU numbering) is D.

8. The heterodimer of claim 1, wherein, in the first polypeptide, the amino acid at position 234 (EU numbering) is L, F, E, or D, and the amino acid at position 270 (EU numbering) is E.

9. The heterodimer of claim 1, wherein, in the first polypeptide, the amino acid at position 234 (EU numbering) is V, I, T, M, or L, and the amino acid at position 327 (EU numbering) is D.

10. The heterodimer of claim 1, wherein,
in the first polypeptide, the amino acid at position 234 (EU numbering) is V, E, D, T, I, L, or F, and the amino acid at position 327 (EU numbering) is D; and
in the second polypeptide, the amino acid at position 330 (EU numbering) is A or K.

11. The heterodimer of claim 1, wherein,
in the first polypeptide, the amino acid at position 234 (EU numbering) is F, E, D, S, or L, and the amino acid at position 270 (EU numbering) is E; and in the second polypeptide, the amino acid at position 330 (EU numbering) is A, F, or K.

12. The heterodimer of claim 1, wherein, when compared to a naturally occurring IgG Fc region, the IgG Fc regions of the first and second polypeptides together exhibit an alteration of function selected from the group consisting of: enhanced binding to an Fcγ receptor, decreased binding to an Fcγ receptor, and increased selectivity of binding to one Fcγ receptor over another.

13. The heterodimer of claim 12, wherein each Fcγ receptor is selected from the group consisting of FcγRIa, FcγRIIa R, FcγRIIa H, FcγRIIb, FcγRIIIaF, and FcγRIIIaV.

14. The heterodimer of claim 12, wherein the alteration of function is increased selectivity of binding to one Fcγ receptor over another.

15. The heterodimer of claim 14, wherein the alteration of function is increased selectivity of binding to at least one activating Fcγ receptor over an inhibitory Fcγ receptor, or vice versa; wherein the at least one activating Fcγ receptor is selected from the group consisting of FcγRIa, FcγRIIa R, FcγRIIa H, FcγRIIIaF, and FcγRIIIaV; and wherein the inhibitory Fcγ receptor is FcγRIIb.

16. The heterodimer of claim 15, wherein binding to the at least one activating Fcγ receptor is selectively enhanced compared to binding to the inhibitory Fcγ receptor.

17. The heterodimer of claim 1, wherein the heterodimer is any one of (A) to (D) below:
(A) the first polypeptide comprises a set of amino acids selected from the group consisting of sets (a) to (h), (r) to (z), and (ad) to (aj); and the second polypeptide comprises the set of amino acids (ak);
(B) the first polypeptide comprises a set of amino acids selected from the group consisting of sets (f), (g), (j), (aa), (ab), and (ac); and the second polypeptide comprises the set of amino acids (an);
(C) the first polypeptide comprises a set of amino acids selected from the group consisting of sets (c), (e) to (g), and (i) to (q); and the second polypeptide comprises the set of amino acids (al); or
(D) the first polypeptide comprises a set of amino acids selected from the group consisting of sets (c), (e) to (h), and (aa) to (ac); and the second polypeptide comprises the set of amino acids (am).

* * * * *

UNITED STATES PATENT AND TRADEMARK OFFICE
CERTIFICATE OF CORRECTION

PATENT NO. : 10,766,960 B2
APPLICATION NO. : 14/654895
DATED : September 8, 2020
INVENTOR(S) : Tomoyuki Igawa et al.

It is certified that error appears in the above-identified patent and that said Letters Patent is hereby corrected as shown below:

In the Specification

At Column 178, Line 50 (approx.): Delete the second instance of Table 56.

At Column 180, Line 51 (approx.): Delete the second instance of Table 58.

At Column 190, Lines 10-12: Delete "When a cell is filled with gray in Table 62, it means that the binding of FchR to IgG was".

At Column 190, Line 53 (above the table): Insert -- TABLE 62 --.

At Column 190, Line 54: Delete "FcgRIIIaF" and insert -- FcgRIIIaV -- therefor.

Signed and Sealed this
Second Day of March, 2021

Drew Hirshfeld
*Performing the Functions and Duties of the
Under Secretary of Commerce for Intellectual Property and
Director of the United States Patent and Trademark Office*